United States Patent 7,745,391 (HUMAN THROMBOSPONDIN POLYPEPTIDE) - sequence listing, part 270

SEQ ID NO: 792421 - protein, 241 aa, Homo sapiens
METAIWRRSYISLISSERPVHNWRGKSVQKKQAESKSQIKLHTQSAPFGLCPKDMMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAPLTAVIYEVQATCWYGAGSRQRSSIQLQAVASAPSCW

SEQ ID NO: 792422 - protein, 164 aa, Homo sapiens
MMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRYQYKGSRTQCHSLEPRKQALFKTKQNKQKKPLTCHIKASECLKYVQYE

SEQ ID NO: 792423 - protein, 220 aa, Homo sapiens
METAIWRRSYISLISSERPVHNWRGKSVQKKQAESKSQIKLHTQSAPFGLCPKDMMLTQAPSSVVRSRNSRNHTVNSGGSCLSASTVAIPAINDSSAAMSACSTISAQPASSMDTQMHSPKKQERVNKRVIWGIEVAEELHWKGWELGKETTRNLVLKNRSLKLQKMKYRPPKTKFFFTVIPQPIFLSPGITLTLPIVFRPLEAGPAHLLHLGVLQPIPD

SEQ ID NO: 792424 - protein, 35 aa, Homo sapiens
MDGGEGCTTASTHVVPLTCTLKNGSNGKFYVIFTT

SEQ ID NO: 792425 - protein, 139 aa, Homo sapiens [sequence omitted]

SEQ ID NO: 792426 - protein, 109 aa, Homo sapiens
VFNLKNTEKKLNRKINCASDIHETSSALAYVVMGVSREQEREKDTGIRFEEIIAENFPNLMKSINLQIQEDQQTPNKMNTRKIQTWTHHSQTVERQIKEQEKIDSQCPE

SEQ ID NO: 792427 - protein, 131 aa, Homo sapiens
HRQAPAPGWVKEFEGCRLNAPVETLGAASALCALVGFALGRRVHAPFSQALCGFLKPLSWCLGRVSGSSISTASPPPLLILPPPGASPAPQRPPCEGYRCRCPAGCRPVRPRSASSGLAWGIDPAPLLLEW

SEQ ID NO: 792428 - protein, 78 aa, Homo sapiens
EEERGDFGRSGVILGRGNVEKGTALRSLCKGTRDRGVLTAAPGFLAVLSRENMKETQAWEKMDTSVVDVLSGRCCLYH

SEQ ID NO: 792429 - protein, 33 aa, Homo sapiens
MAAGGVPRPRDRCCSPRVSMAVWCASKLGLSIL

SEQ ID NO: 792430 - protein, 80 aa, Homo sapiens
SLTAPHEIIIHYVTRREEREYFVKLSHSKPPPEARRRPQSCEHSRDLPTDTLKSQHDSGKHFQRVFYLGQIIFRFVSERQ

SEQ ID NO: 792431 - protein, 460 aa, Homo sapiens
KTFSRSFSLKLHQNIHTGEKPFECSNCRKAFRQISSILLHQRIHSGKKSHECNKCGESFNQRTTLILHMRIHDGKEILDCGKALSQCQSFNIHQKIHVVGNVCQCRKCGKAFNQMSSLLLHKKIHNGKKTHKYNKCGRGFKKKSVFVVHKRIHAGEKIPENAKALSQSLQQRSHHLENPFKCRKCGKLFNRISPLMLHQRIHTSEKPYKCDKCDKFFRRLSTLILHLRIHNGEKLYRCNKCEKVCNRHSSLIQHQKVHTKKKKLFECKECGKMFSGTANLKIHQNIHSEEKPFKCNKCSKVFGRQSFLIEHQRIHTGEKPYQCEECGKAFSHRISLTRHKRIHTEDRPYECDQCGKAFSQSAHLAQHERIHTGEKPYTCKTCGKAFSQRTSLILHERSHTGEKPYECNECGKAFSSGSDLIRHQRSHSSEKPYECSKCGKAYSRSSSLIRHQNTHSEEKA

SEQ ID NO: 792432 - protein, 460 aa, Homo sapiens; identical to SEQ ID NO: 792431

SEQ ID NO: 792433 - protein, 279 aa, Homo sapiens [sequence omitted]

SEQ ID NO: 792434 - protein, 275 aa, Homo sapiens
MFPLLYELTAVSPSPFPQRTAFPASGKKRETDYSDGDPLDVHKRLPSSTGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 792435 - protein, 195 aa, Homo sapiens
MTAFPASGKKRETDYSDGDPLDVHKRLPSSTGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKNVMLQTAELKKSRH

SEQ ID NO: 792436 - protein, 650 aa, Homo sapiens
ESASLPENTAQVESNEVMGAPDDRTRTPLEPSNCWSDLDGGSHTENVGEAAVTQVGEQADTVASCPLGHSDDTVYHDDRCMVEVPQQLETSIGHSLEKEFTNQEAAEPKEVPVQSTEAGRDHNEEEGEEKGLRDEKPIKTEVPGSPAGTESKGQEATGPSTVDTQSEPSDMKEPDEEKNDQQGEALDSLQKRKNKKKKKKRKKSPVPIETLKDVEKELTYQNTDLSEIKEEEQVKSTDRKSAVEAQNEVTENPKQKIAAESSENVDCPENPKMKLDGKLDQEGNDVKTAAEEVLAGRDTLDFEDVTVQSSGPRAGGEELDEGVAKDNAKIDGATYSNPEEPESEDADHCTVPKNESPSQDISDACEAESTERCGMSEHPSQTIRKALDSNSLKNHDLLAPGGEPGDFNPESREDTRGGNEKGKAKKTVPCPKLRQAAGVVHRKSECEGLFFSPLPMTAFPASGKKRETDYSDGDPLDVHKRLPSSTGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKNVMLQTAELKKSRH

SEQ ID NO: 792437 - protein, 275 aa, Homo sapiens; identical to SEQ ID NO: 792434

SEQ ID NO: 792438 - protein, 257 aa, Homo sapiens [sequence omitted]

SEQ ID NO: 792439 - protein, 298 aa, Homo sapiens
REEDIYQFAYCYPYTYTRFQHYLDSLQKRNMDYFFREQLGQSVQQRKLDLLTITSPDNLREGAEQKVVFITGRVHPGETPSSFVCQGIIDFLVSQHPIACVLREYLVFKIAPMLNPDGVYLGNYRCSLMGFDLNRHWLDPSPWVHPTLHGVKQLIVQMYNDPKTSLEFYIDIHAHSTMMNGFMYGNIFEDEERFQRQAIFPKLLCQNAEDFSYSSTPFNRDAVKAGTGRRFLGGLLDHTSYCYTLEVSFYSYIISGTTAAVPYTEEACILSPHPALGQPSSSREYPSLTGQELGPQLR

SEQ ID NO: 792440 - protein, 180 aa, Homo sapiens
RVGLDGRICEAILTPSSRARLVEDRFGNPPTLRGPKTKDAKPYKFSTADSERWKGNQDKKPKCLLEEDIASQNNCERCKHSPGNKQHNSFKALKDEDLPVEKYLMERQPVGEPAADQVAMDVMHSPILQLERKHKVSSDSNQTETTAEKLPEDSFLKNKQKQVYIGLHPKKHHLMHLREQ

SEQ ID NO: 792441 - protein, 192 aa, Homo sapiens
RVGLDGRICEAILTPSSRARLVEDRFGNPPTLRGPKTKDAKPYKFSTADSERWKGNQDKKPKCLLEEDIASQNNCERCKHSPGNKQHNSFKALKDEDLPVEKYLMERQPVGEPAADQVAMDVMHSPILQLERKHKVSSDSNQTETTAEKLPEDSFLKNKQKQVYIGPPPKNKVLSNNASSQKPTHSSAEIHQ

SEQ ID NO: 792442 - protein, 107 aa, Homo sapiens
TGHTPAGPGTGLCVPMATAAALLDRPKPSSWVEHHHHWGHPGKGKVFQNHKCFSHKPQQSPEQLDTLCIVYKDSKGPMAADQDGGVSASSQRTILTLQAMRSRRGRQ

SEQ ID NO: 792443 - protein, 99 aa, Homo sapiens
MAQLEGYCFSAALSCTFLVSCLLFSAFSRALREPYMDEIFHLPQAQRYCEGHFSLSQWDPMITTLPGLYLVSVGVVKPAIWIFAWSEHVVCSIGMLRFV

SEQ ID NO: 792444 - protein, 144 aa, Homo sapiens
MIATGLRDAGARPERRCHSKSTASRAKARDLTRKGDSPPVPLGRPSGTHRPGSRRLAGRKGCQARRASREAASSGIKDVPRTWAGRQPGTPGGRAPTAQEPTPASTGKISPEPTCRGSHSRLEPSQSPAPRPPRAQAAPPSAAA

SEQ ID NO: 792445 - protein, 156 aa, Homo sapiens
SCHPAQVVRLAGREQDAAARVPQLSQVRAGGAPSLLSPALEAPSETLHGADWWVSRPWHRGVALANRSPAPPRGPDVSPDVAKSDSGSQMPTWSVYADHPFLQRDRRLLEVFCDLSGPDGLRNIARSSRVRGSLWLSTDDLPFRLCYRINRESVCS

SEQ ID NO: 792446 - protein, 101 aa, Homo sapiens
RACHARDAQMLLGLQRSKLAGPRGPSPRGRWISGAPHPLRRISRKWTEEYIATIISALGLVRVAGLGQSPAWAVDIKIRRALPALCGQKDERIALLLRFHC

SEQ ID NO: 792447 - protein, 380 aa, Homo sapiens
QSGSGALPGLTATPEAMLRFLPDLAFSFLLILALGQAVQFQEYVFLQFLGLDKAPSPQKFQPVPYILKKIFQDREAAATTGVSRDLCYVKELGVRGNVLRFLPDQGFFLYPKKISQASSCLQKLLYFNLSAIKEREQLTLAQLGLDLGPNSYYNLGPELELALFLVQEPHVWGQTTPKPGKMFVLRSVPWPQGAVHFNLLDVAKDWNDNPRKNFGLFLEILVKEDRDSGVNFQPEDTCARLRCSLHASLLVVTLNPDQCHPSRKRRAAIPVPKLSCKNLCHRHQLFINFRDLGWHKWIIAPKGFMANYCHGECPFSLTISLNSSNYAFMQALMHAVDPEIPQAVCIPTKLSPISMLYQDNNDNVILRHYEDMVVDECGCG

SEQ ID NO: 792448 - protein, 193 aa, Homo sapiens
QSGSGALPGLTATPEAMLRFLPDLAFSFLLILALGQAVQFQEYVFLQFLGLDKAPSPQKFQPVPYILKKIFQDREAAATTGVSRDLCYVKELGVRGNVLRFLPDQGFFLYPKKISQASSCLQKLLYFNLSAISLNSSNYAFMQALMHAVDPEIPQAVCIPTKLSPISMLYQDNNDNVILRHYEDMVVDECGCG

SEQ ID NO: 792449 - protein, 234 aa, Homo sapiens
QSGSGALPGLTATPEAMLRFLPDLAFSFLLILALGQAVQFQEYVFLQFLGLDKAPSPQKFQPVPYILKKIFQDREAAATTGVSRDLCYVKELGVRGNVLRFLPDQGFFLYPKKISQASSCLQKLLYFNLSAIKEREQLTLAQLGLDLGPNSYYNLGPELELALFLVQEPHVWGQTTPKPGKMFVLRSVPWPQGAVHFNLLDVAKDWNDNPRKNFGLFLEILVKEDRDSGVNFQP

SEQ ID NO: 792450 - protein, 252 aa, Homo sapiens
QSGSGALPGLTATPEAMLRFLPDLAFSFLLILALGQAVQFQEYVFLQFLGLDKAPSPQKFQPVPYILKKIFQDREAAATTGVSRDLCYVKELGVRGNVLRFLPDQGFFLYPKKISQASSCLQKLLYFNLSAIKEREQLTLAQLGLDLGPNSYYNLGPELELALFLVQEPHVWGQTTPKPGKMFVLRSVPWPQGAVHFNLLDVAKDWNDNPRKNFGLFLEILVKEDRDSGVNFQPEDTCARLRCSHFHALPGQ

SEQ ID NO: 792451 - protein, 472 aa, Homo sapiens
PRPLQPLAELNPSRVMAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLALQSVGESRLWQGHHATESEHSLSPADLGSPASPKESSEALDAAAALSVAECVERMAPTLPKSDLNEVKELLKTNKKLAKMIGHIFEMNDDDPHKEEEIRKYSAIYGRFDSKRKDGKHLTLHELTVNEAAAQLCVKDNALLTRRDELFALARQISREVTYKYTYRTTKSKCGERDELSPKRIKVEQPEKVMAKQMEFLCNQAGYERLQHAERRLSAGLYRQSSEEHSPNGLTSDNSDGQGERPLNLRMPNLQNRQPHHFVVDGELSRLYPSEAKSHSSESLGILKDYPHSAFTLEKKVIKTEPEDSR

SEQ ID NO: 792452 - protein, 502 aa, Homo sapiens
PRPLQPLAELNPSRVMAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLALQSVGESRLWQGHHATESEHSLSPADLGSPASPKESSEALDAAAALSVAECVERMAPTLPKSDLNEVKELLKTNKKLAKMIGHIFEMNDDDPHKEEEIRKYSAIYGRFDSKRKDGKHLTLHELTVNEAAAQLCVKDNALLTRRDELFALARQISREVTYKYTYRTTKSKCGERDELSPKRIKVEDGFPDFQDSVQTLFQQARAKSEELAALSSQQPEKVMAKQMEFLCNQAGYERLQHAERRLSAGLYRQSSEEHSPNGLTSDNSDGQGERPLNLRMPNLQNRQPHHFVVDGELSRLYPSEAKSHSSESLGILKDYPHSAFTLEKKVIKTEPEDSR

SEQ ID NO: 792453 - protein, 90 aa, Homo sapiens
LATCIPRERVSLRLTSDNSDGQGERPLNLRMPNLQNRQPHHFVVDGELSRLYPSEAKSHSSESLGILKDYPHSAFTLEKKVIKTEPEDSR

SEQ ID NO: 792454 - protein, 320 aa, Homo sapiens
PRPLQPLAELNPSRVMAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLALQSVGESRLWQGHHATESEHSLSPADLGSPASPKESSEALDAAAALSVAECVERMAPTLPKSDLNEVKELLKTNKKLAEIRKYSAIYGRFDSKRKDGKHLTLHELTVNEAAAQLCVKDNALLTRRDELFALARQISRHAPITHLLDPPIHNVLT

SEQ ID NO: 792455 - protein, 502 aa, Homo sapiens; identical to SEQ ID NO: 792452

SEQ ID NO: 792456 - protein, 367 aa, Homo sapiens
PRPLQPLAELNPSRVMAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLALQSVGESRLWQGHHATESEHSLSPADLGSPASPKESSEALDAAAALSVAECVERMAPTLPKSDLNEVKELLKTNKKLAKMIGHIFEMNDDDPHKEEEIRKYSAIYGRFDSKRKDGKHLTLHELTVNEAAAQLCVKDNALLTRRDELFALARQISREVTYKYTYRTTKMGFQISRILCKHSSSRLELRVKNLQLLVHSSLKR

SEQ ID NO: 792457 - protein, 420 aa, Homo sapiens
PRPLQPLAELNPSRVMAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLALQSVGESRLWQGHHATESEHSLSPADLGSPASPKESSEALDAAAALSVAECVERMAPTLPKSDLNEVKELLKTNKKLAKMIGHIFEMNDDDPHKEEEIRKYSAIYGRFDSKRKDGKHLTLHEDGFPDFQDSVQTLFQQARAKSEELAALSSQRLQHAERRLSAGLYRQSSEEHSPNGLTSDNSDGQGERPLNLRMPNLQNRQPHHFVVDGELSRLYPSEAKSHSSESLGILKDYPHSAFTLEKKVIKTEPEDSR

SEQ ID NO: 792458 - protein, 74 aa, Homo sapiens
VLAAEGEMNASKSLKSASMVLAESPIALQLRYLQTLSTVATEKNSTIVFPLPMNILEGIGGVSYDNHKKLPNKA

SEQ ID NO: 792459 - protein, 155 aa, Homo sapiens
MQGSHSAVQAGVWWCHHDSLQPWPPGLRRSSCLSLQSLWDYRSLALSLRLACNGTTSAHCDLCLLSSSDSPASASQVAGITGEKTAEPHKAHAAQGERHLSSHMSPDENMTEKFCPGPRASFHLRILAASRHLVKRLLNEYTVTVLRDKSYLRNN

SEQ ID NO: 792460 - protein, 155 aa, Homo sapiens; identical to SEQ ID NO: 792459

SEQ ID NO: 792461 - protein, 145 aa, Homo sapiens
VFAGSSEQDANLAKQFWISASMYPPSESQLVLRRDSSQRLPVARPRRSRGSENSHSSQSFHLASNKNRDIFAEALKIQESEEKVKYLQKAKTREEILQLLRKQREERISKELISLPYKPKAKEHKAKKVVSESDKEDQEEVKTLD

SEQ ID NO: 792462 - protein, 172 aa, Homo sapiens
VFAGSSEQDANLAKQFWISASMYPPSESQLVLRRDSSQRLPVARPRRSRGSENSHSSQSFHLASNKNRDIFAEALKIQESEEKVKYLQKTRSHSVTQNEVQWHDHGSLQPQLSRIQAKTREEILQLLRKQREERISKELISLPYKPKAKEHKAKKVVSESDKEDQEEVKTLD

SEQ ID NO: 792463 - protein, 95 aa, Homo sapiens
VFAGSSEQDANLAKQFWISASMYPPSESQLVLRRDSSQRLPVARPRRSRGSENSHSSQSFHLASNKNRDIFAEALKIQESEEKVKYLQKITGTIV

SEQ ID NO: 792464 - protein, 38 aa, Homo sapiens
MTVVSIEAMALVLVCSGVSGLERSPWTQELPLRNVQVV

SEQ ID NO: 792465 - protein, 243 aa, Homo sapiens
FNRGSNLVQHQSIHTGEKPYECKECGKAFRLHLQLSQHEKTHTGEKPFECKECGKFFRRGSNLNQHRSIHTGKKPFECKECGKAFRLHMHLIRHQKFHTGEKPFECKECGKAFSLHTQLNHHKNIHTGEKPFKCKECGKSFNRVSNLVQHQSIHAGVKPYECKECGKGFSRVSNLIQHQKTHSSAKPFVCKECRKTFRYHYQLTEHYRIHTGEKPFECKECGKAFGLLTQLAQHQIIHTGEKP

SEQ ID NO: 792466 - protein, 225 aa, Homo sapiens
FNRGSNLVQHQSIHTGEKPYECKECGKAFRLHLQLSQHERRGSNLNQHRSIHTGKKPFECKECGKAFRLHMHLIRHQKFHTGEKPFECKECGKAFSLHTQLNHHKNIHTGEKPFKCKECGKSFNRVSNLVQHQSIHAGVKPYECKECGKGFSRVSNLIQHQKTHSSAKPFVCKECRKTFRYHYQLTEHYRIHTGEKPFECKECGKAFGLLTQLAQHQIIHTGEKP

SEQ ID NO: 792467 - protein, 151 aa, Homo sapiens
MFEICVFNPYVFLAAKKDQLQVNNAQLNCDSCQLYHCLNHSTIQTHSISTLIILGRIPGLWIPVNLSEPWAATPTLHFVKLLTQLTHGTRRALGMIIFTIVSLITLIPSVVVSSVALDSSTQTAQYAENWMHTADQAWMFQNKTNTEIQTE

SEQ ID NO: 792468 - protein, 118 aa, Homo sapiens
RAAGSGWNCSRPADFTRARGPHLPGAACSMAPSAVSPPQAPRRPLLGPWGLRAAGITETHIPVASSLSLCSEERQKGILLFPSRFLHLPSSDKPKNLPSEKTARISRYLGVEVGLRAS

SEQ ID NO: 792469 - protein, 107 aa, Homo sapiens
LESYRKFMMPLKLLLRCRHLLHLLISLWPMYDIDIQPIPKSLNEDIILQKSSAWANTNSPLTEKWESKKLQTTIQSSTRRITCLKQTTIKYNHLYLSSSFCHFGWLS

SEQ ID NO: 792470 - protein, 114 aa, Homo sapiens
MPLPGDRSLGCTKAEQLGTVGMRNIRGRWALYRKRFSCVWTRRFLIRLFTATSDEKPSDIIQKCSGGDRTNHFYTLIFPSRLYIIFSVLAGESNSFFKTRDTCSTWQGFHKNIW

SEQ ID NO: 792471 - protein, 340 aa, Homo sapiens
MRKELQLSLSVTLLLVCGFLYQFTLKSSCLFCLPSFKSHQGLEALLSHRRGIVFLETSERMEPPHLVSCSVESAAKIYPEWPVVFFMKGLTDSTPMPSNSTYPAFSFLSAIDNVFLFPLDMKRLLEDTPLFSWYNQINASAERNWLHISSDASRLAIIWKYGGIYMDTDVISIRPIPEENFLAAQASRYSSNGIFGFLPHHPFLWECMENFVEHYNSAIWGNQGPELMTRMLRVWCKLEDFQEVSDLRCLNISFLHPQRFYPISYREWRRYYEVWDTEPSFNVSYALHLWNHMNQEGRAVIRGSNTLVENLYRKHCPRTYRDLIKGPEGSVTGELGPGNK

SEQ ID NO: 792472 - protein, 208 aa, Homo sapiens
MLLQINASAERNWLHISSDASRLAIIWKYGGIYMDTDVISIRPIPEENFLAAQASRYSSNGIFGFLPHHPFLWECMENFVEHYNSAIWGNQGPELMTRMLRVWCKLEDFQEVSDLRCLNISFLHPQRFYPISYREWRRYYEVWDTEPSFNVSYALHLWNHMNQEGRAVIRGSNTLVENLYRKHCPRTYRDLIKGPEGSVTGELGPGNK

SEQ ID NO: 792473 - protein, 139 aa, Homo sapiens
MRKELQLSLSVTLLLVCGFLYQFTLKSSCLFCLPSFKSHQGLEALLSHRRGIVFLETSERMEPPHLVSCSVESAAKIYPEWPVVFFMKGLTDSTPMPSNSTYPAFSFLSAIDNVFLFPLDMKRLLEDTPLFSWYNQVSV

SEQ ID NO: 792474 - protein, 130 aa, Homo sapiens
PPSATRAHPHIDSREYPPHMDPLTHTHTHTHTHTHSEILSQTETHTHTHTHTRKKCISKETTRNVHIPFDHFAFVSFLCHRFPAKLIQSPVGLTCSSLQNILQSFWEYLIATATRIPKYFPNTLAAGSKI

SEQ ID NO: 792475 - protein, 108 aa, Homo sapiens
SSTFIGSFFHLPNKKQTKKNWKHTLNAERISPLKTVSHCEDIKFIVADGERPFPCRSKKDVLILIPGSCEYLPGMLKVRFLRWRKDLDYSAGPTKGMQEAGESEKEMW

SEQ ID NO: 792476 - protein, 82 aa, Homo sapiens
LISPGKKSQTQCQRRGNASNPEQQTQLLSHGTPRADIASRSQHPFPGSLGSASRLCFRFTKLCTASSHQLELVQNMETLCSA

SEQ ID NO: 792477 - protein, 82 aa, Homo sapiens; identical to SEQ ID NO: 792476

SEQ ID NO: 792478 - protein, 224 aa, Homo sapiens
VFLLCSLRMWMLLICGPHFEKYTGDSCGGKNSHPGIKTCLHILAMELGGLALLLRMEYSGAILSHCSIDLWGLSHPCTSASQVAGTTGDATKGAILEVDTRPSPDTKPAGASIFNFQPPECHGFWKKRLKMFSVAAVFRHHESLLLPSIKTNNKTLQRKSPQKHADFRRIHDLEYFYKYLRKQESFPYIWSLEILSIYMVLGESSFYEKGDFQNLLHFTISILA

SEQ ID NO: 792479 - protein, 95 aa, Homo sapiens
GRGKSVVPEGRWAPLQAPCSPAITSRTFWLTDQGQVDWVQSDRPFTFNSFGSADMYTYKVEPTRSGAFCPRHRTKDCPAGRWQEQFLTSVEYLWP

SEQ ID NO: 792480 - protein, 119 aa, Homo sapiens
LLDQMFLASSTATSPSRHQQTLTAKKTLELLLLCWVRGNMLCLWLELSFLQHSTLMGRSSICTTLLKWNSSRTQWLMSVIPTLWEAEVGGSPDVRSSRPAWSTWRNPVSTKNTKISWAW

SEQ ID NO: 792481 - protein, 118 aa, Homo sapiens
QRNSMEKLSKDGVDLITRKEKKANLMEQLFGASGSSTISSKSSDPNSVASSKGDIDPLNFLPGNKGSRDQEHDEDEDFFLSEGRSFNPNRHRLKHADDKPAVKAADSVEDEIEEVALR

SEQ ID NO: 792482 - protein, 442 aa, Homo sapiens
MGVARSFIIKRKDGTRRTIKTHTPCEGENTAREIRRSTTETDATPTTSGAGRPKQMHPPLTHNNEYLRHPMRESKTNREQRGTVRIKKRDSICRLLRDKNYTPRVDYNLVQNLYQQERKMIKTRTDTSQREKQQRSEEERQEKQGRGTRHRQEKERREDRDRESEAARQQRRRRRRGERRRGRRERNEKKKSTGTKDRKHEHTRTAEGGGTASTERTTGERADKKKGKRRRKRGEAGESGKARNPDDKGNRRRETAGGRREKGETEEEGREEKMKGAEEEEAKAGTEKRKSRREDRRSGEGERQTAAERRGGERERGEEGKQGTRARGKEGETARVERGTGEGDEPGNGGEGREEQERGEETRDAEEEAGEAPRKAGRGEKRNRGEGRGREEKREKSRTGAGERGKDREESDGAGGKVTTQGREENAPEEQGKQGTHGREGK

SEQ ID NO: 792483 - protein, 206 aa, Homo sapiens
QQPNAHRISQPIRQIIYGLLLNASPHLDKTSWNALPPQPLAFSEVERINNLSRLTELSLRRRQMLLLETLKVKQTILEPIPTSLKLPIAVSCYWLQHTETKAKLHHLQSLLLTMLVGPLIAIINSPGKEELQEDGAKMLYAEFQRVKAQTRLGTRLDLDTAHIFCQWQSCLQMGMYLNQLLSTPLPEPDLTRLYSGSLVHGLCQQL

SEQ ID NO: 792484 - protein, 111 aa, Homo sapiens [sequence omitted]

SEQ ID NO: 792485 - protein, 279 aa, Homo sapiens
LWPATCLWGGGSGSGVRCALLGATCLFACVPLSSVALESRRAAPSLDMSYNYVVTAQKPTAVNGCVTGHFTSAEDLNLLIAKNTRLEIYVVTAEGLRPVKEVGMYGKIAVMELFRPKGESKDLLFILTAKYNACILEYKQSGESIDIITRAHGNVQDRIGRPSETGIIGIIDPECRMIGLRLYDGLFKVIPLDRDNKELKAFNIRLEELHVIDVKFLYGCQAPTICFVYQDPQGRHVKTYEVSLRGKGNSIKGPLRNPGKHVRKVEAFPWGISKSPESP

SEQ ID NO: 792486 - protein, 87 aa, Homo sapiens
IGIIDPECRMIGLRLYDGLFKVIPLDRDNKELKAFNIRLEELHVIDVKFLYGCQAPTICFVYQVLDQEERARNCEVDVIGVVFANWH

SEQ ID NO: 792487 - protein, 94 aa, Homo sapiens
SLGVCWETAAGIRTLPGAESEAGWKSSSSNSAPRQLFDCCQVPQLWEPQAFICEMAIPVFLTRLLEDFIEDTVLVFQHFNISGLKLCHKIDHKP

SEQ ID NO: 792488 - protein, 108 aa, Homo sapiens
SHFQINSEIHLVWVRQHHTRHSSQFIVLEETSKIHLSLLLSCEKPCDSYAVIATSVTVRTGAAYSSFKARRAATAGFLNLGTTNILSRVFSRGAALCIVGCLAALDAH

SEQ ID NO: 792489 - protein, 118 aa, Homo sapiens
MGQLDSEGNVEILISRRCWCQKYDKRLIDGPGAVAHACIPSTLGGQGGWIMRSRVRDHPGQYGETLSLLKIQKISWAWWHASVVPTTWEAEAGELLEPGGGGCSEQRSCHCSPAWAAD

SEQ ID NO: 792490 - protein, 94 aa, Homo sapiens
SARLRRGKQPRALLPPALCRRQPAEPTAGAQRAQQLLSPGSKGGRRDEPVAMTQTRTTPIAEPAELLGGRGCSELRFCDYTPTWATERDSIPKK

SEQ ID NO: 792491 - protein, 104 aa, Homo sapiens
MGQLDSEGNVEILISRRCWCQKYDKRLIDGPGAVAHACIPSTLGGQGGWIMRSRVRDHPGQYGETLSLLKIQKISWAWWHASVVPTTWEAEAGESLEPRVWKLQ

SEQ ID NO: 792492 - protein, 134 aa, Homo sapiens
GSGGDPAGSARLRRGKQPRALLPPALCRRQPAEPTAGAQRAQQLLSPGSKGGRRDEPVAMTQTRTTPIAEPAELLGEWPPGGISCSQPGGGFGDPGCGAASSHAFSSPRYGVKNPRDPRVSVHQGRSRLPRNVA

SEQ ID NO: 792493 - protein, 126 aa, Homo sapiens
ESQGGPGLGAPSSSAPFAGTPGVCPLAPFRPVTPATGPSKRLVPKMFTMGFLKTVLLGTSACVSPPTMPAFFSLPAERRLQAWPQSEAPLSVSSCFQNRPPEPASFQNLRPEPASLQNLRTEPTSF

SEQ ID NO: 792494 - protein, 116 aa, Homo sapiens
MYHLLSSPGYRSSDFIHVSLSLMTGALNTLSIDRHTHTFAYPFLCLVSQPVWTTSEMPCSLLLMQSPSRRQTGGRRVNYTIPLFLPVLILAWLCPWPATTAPLKKATSSQLSPVLW

SEQ ID NO: 792495 - protein, 76 aa, Homo sapiens
LWSSRSCPHLNRSPGEEVKLLQRRLRFVKPKGSRASMAHSSQQVLWGAQMDKGENDCHQPVSTCLASRERALKIQW

SEQ ID NO: 792496 - protein, 143 aa, Homo sapiens
TESRSVTQVGVQWHDIGSLQPPPPRFKRFSCLSLPSSWDYRITGVCHHAQLIFVFLVETGFHLNSGSRGCGELRLHHCTPAWVTEPDSVSKKRKKKICKQSQHSPTGKQSKNVQNVHETLLHSHGADQAADKLQSQRERPHFK

SEQ ID NO: 792497 - protein, 125 aa, Homo sapiens
TESRSVTQVGVQWHDIGSLQPPPPRFKRFSCLSLPSSWDYRITGVCHHAQLIFVFLVETGFHLNSGSRGCGELRLHHCTPAWVTEPDSVSKKRKKKICKQSQHSPTGKQSKNVQNVHETLLHSHK

SEQ ID NO: 792498 - protein, 117 aa, Homo sapiens
SKLSKFPLAVSAKRVFQNCSMKCYVQLCELNTNITKKFLRILLSSFYGKIFPFPPWASKRSKCPLADSTKRVFQTCSLKRKFQLCELKAHITKKFVRMLLSSVYVNIFPFQTKASKQ

SEQ ID NO: 792499 - protein, 169 aa, Homo sapiens
IKIELKHAQQKLLDSTKMCSSLTAEYKHCQQKIKELELEVLKHTQSIKSQNNLQEKLVQEKSKVADAEEKILDLQRKLEHAHKVCLTDTCISEKQQLEEKIKEATQNEAKVKQQYQEEQQKRKLLYQNVDELHRQVRTLQDKENLLEMTCSQQQSRIQQQEALLKQLEN

SEQ ID NO: 792500 - protein, 118 aa, Homo sapiens
MESRSVTQAGVQWRDLGSLQPPPPRFKRFSCFVSLVETGFRHVGQAGLKLLTSGDPPAWTSQSAGITGVSYRARPFHVLKNIFCHPLVDSGSPPAQEATQADVNGDQAGTGIVVSLAL

SEQ ID NO: 792501 - protein, 433 aa, Homo sapiens
MGDWSFLGNILEEVNEHSTVIGRVWLTVLFIFRILILGTAAEFVWGDEQSDFVCNTQQPGCENVCYDEAFPISHIRLWVLQIIFVSTPSLMYVGHAVHYVRMEEKRKSREAEELGQQAGTNGGPDQGSVKKSSGSKGTKKFRLEGTLLRTYICHIIFKTLFEVGFIVGHYFLYGFRILPLYRCSRWPCPNVVDCFVSRPTEKTIFILFMLSVASVSLFLNVMELGHLGLKGIRSALKRPVEQPLGEIPEKSLHSIAVSSIQKAKGYQLLEEEKIVSHYFPLTEVGMVETSPLPAKPFNQFEEKISTGPLGDLSRGYQETLPSYAQVGAQEVEGEGPPAEEGAEPEVGEKKEEAERLTTEEQEKVAVPEGEKVETPGVDKEGEKEEPQSEKVSKQGLPAEKTPSLCPELTTDDARPLSRLSKASSRARSDDLTV

SEQ ID NO: 792502 - protein, 144 aa, Homo sapiens
YYSLVEMYWNSCLLPAVLHGIISWYYPHRETNFTTASPDKIKKWSPREVKQFAQDHTAAICIATKFVTCLNFHHHSYFCHTLDPPSTKNEYSDMATHLRNPFTSHRRKRIPQIPQRQLFFLKTAALPVMRATFPIQVGGQVTFV

SEQ ID NO: 792503 - protein, 74 aa, Homo sapiens
APPSTSPIPPPPRTPLGTPPGAEIGFTEPGENDSGVVVRGCAPAVPVRVVFTRAQWWPMGSRPLSPPQARGDGI

SEQ ID NO: 792504 - protein, 99 aa, Homo sapiens
VCERKPGIWLLTFQYNLLLCIWMTSLLCPLQRCAYRALTVQELLRTEPGNPDDLVDPVPPKGGAHGDCTLVTDWQAICLLQPTKSHRSFWILCSRLFIP

SEQ ID NO: 792505 - protein, 107 aa, Homo sapiens
KIILLQGLLRNSSEVGEHLRISQLCSTGFTNISRGHSQSSSPTNHSWHAKQLLEVPMLTCDHESFLSVLLTCDHESCLPVLLTCDHESCLSVLLTCDDCLSVLLTNF

SEQ ID NO: 792506 - protein, 118 aa, Homo sapiens
QKHLPKERSDQGTPQLKTLPWLPVPLEKTLISFRLCSSITSSLSLPTTHASATAAFFLAPRLYQAHSYPRPFALPVSSTERVLPQPLTRPFRHSANISMTLSILLPPDHYLFVSAFSL

SEQ ID NO: 792507 - protein, 122 aa, Homo sapiens
SLPAGCFASSAGPARPTFGSPSNSFHFLPRLPPTPRFSASPPFLFSLAPHFICLSTPFSLPTPPPFSSAPPAPHPFPAYQARDPGLRMENEWARCLELGWGLGEGRHHCDPFLWGVSLFKVH

SEQ ID NO: 792508 - protein, 123 aa, Homo sapiens
KYILIALETRSAKSRHWQALAPSAGSKGRAFFAASSFQGPQAFFGLWLHHSSPCLCLRVTFSSVFSPSRLLNNTCCHVQQGIPVVPATREAEAGGLLDPGVLGCSALHQSSVCTKFSINMVTS

SEQ ID NO: 792509 - protein, 77 aa, Homo sapiens
GALCATIFPMSSSNVSILLEDIGWILLAGWILWSKLEREGNSPSLMTGAGWTLQESRGHWVWKSQRSQRNNALEAAE

SEQ ID NO: 792510 - protein, 99 aa, Homo sapiens
RIKGTGGDTGPLQPQEDQQWPGLLVSSFVVGTLSPGPASYLASWLIILPEASPAWGCWRVPGPTWLGMECKPRRCHVRVQRGVGLSKSKERDCIRHRIC

SEQ ID NO: 792511 - protein, 109 aa, Homo sapiens
GGRGRGQKGEAWGSETNVSCLLPHGHVARPLTHSGLCSNVPLHERPFWTTHPITLYLLTLLYFHSLHLSPLDISSICLFSCLSIQSVHLMITGTLFCSLLGSDLSSANY

SEQ ID NO: 792512 - protein, 107 aa, Homo sapiens
MSHLTPVVIKQPYLGSICSGHILVLPLPGFHLQWPHPHPPTPWFPSAVATSSSSGSLGSICSSHLLILRLSGFHLQWPHPRPPAVWVPSAVATSSSSSSLSKFSAQT

SEQ ID NO: 792513 - protein, 109 aa, Homo sapiens
MVILELEIIPVLCCTGNGQVCLFFSFFLHQIVLLRDAGIGPHFPKPGRSLNVSTDHFSQSFFGSWQEGILGMDRCLIITVLSRAIFFIGPICARVQGTMSPSARLLALQ

SEQ ID NO: 792514 - protein, 110 aa, Homo sapiens
HLLTVTPCAHPQTINNYESTLFFYMFALLDITCRWNHTVCVLLCLASFTQHVFKVHVIECISTSFIFHGQIIYSFNFRSILNLFLHLLVGGYLGCFYFLDIVSNAAMNPE

SEQ ID NO: 792515 - protein, 291 aa, Homo sapiens
MLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDGHFNPEVVKYRQLCFKSQYKRYLNSQQQYFHRLLKQILASRSDLLEMARRSGPALPFRQKRPSPSRTPEEREWRTQQRYLKVLREVKEECGDTALSSDEEGTLDLQEQFSFEDLSSWLPSSPARSPSPAVPLRVVPTLSTTDMKTADKVELGDSDLKIMLKKHHEKRKHQPVRWEGRAAVWFSA

SEQ ID NO: 792516 - protein, 334 aa, Homo sapiens
GTQTPCGSERVWEPAAGEGLRVRGPAPAVQSTCGEETMDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDGHFNPEVVKYRQLCFKSQYKRYLNSQQQYFHRLLKQILASRSDLLEMARRSGPALPFRQKRPSPSRTPEEREWRTQQRYLKVLREVKEECGDTALSSDEEGTLDLQEQFSFEDLSSWLPSSPARSPSPAVPLRVVPTLSTTDMKTADKVELGDSDLKIMLKKHHEKRKHQPVRWEGRAAVWFSA

SEQ ID NO: 792517 - protein, 142 aa, Homo sapiens
MLCMKDQGIKKSGRPSPSRTPEEREWRTQQRYLKVLREVKEECGDTALSSDEEDLSSWVPSSPARSPSPAVPLRVVPTLSTTDMKTADKVELGDSDLKIMLKKHHEKRKHQPDHPDLLTGDLTLNDIMTRVNAGRKGSLAGK

SEQ ID NO: 792518 - protein, 320 aa, Homo sapiens
MDSRGLPAWTSQSTEISTCGEETMDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDGHFNPEVVKYRQLCFKSQYKRYLNSQQQYFHRLLKQILASRSDLLEMARRSGPALPFRQKRPSPSRTPEEREWRTQQRYLKVLREVKEECGDTALSSDEEGTLDLQEQFSFEDLSSWLPSSPARSPSPAVPLRVVPTLSTTDMKTADKVELGDSDLKIMLKKHHEKRKHQPVRWEGRAAVWFSA

SEQ ID NO: 792519 - protein, 469 aa, Homo sapiens
LPLQTTSVGKTAPERNVEIPPSSPNPDGKGYLAGTLAPLQMRKRENHPKKRVARTVGEHTQVKCEPGKLLVEPDVKGVPCVISSGISQLGHSQPFKQEWLNKHSMQNRIVHSPEVKQQKRLLPSCSFQQNLFHVDKNGGFHTDAGTSHRQQFYQMPVAARGPIPTAALLQASSKTPVGCNAFAFNRHLEQKGLGEVSLSSAPHQLRLANMLSPNMPMKEGDEVGGTAHTMPNKALVHPPPPPPPPPPPPLALPPPPPPPPPLPPPLPNAEVPSDQKQPPVTMETTKRLSWPQSTGICSNIKSEPLSFEEGLSSSCELGMKQVSYDQNEMKEQLKAFALKSADFSSYLLSEPQKPFTQLAAQKMQVQQQQQLCGNYPTIHFGSTSFKRAASAIEKSIGILGSGSNPATGLSGQNAQMPVQNFADSSNADELELKCSCRLKAMIVCKGCGAFCHDDCIGPSKLCVACLVVR

SEQ ID NO: 792520 - protein, 227 aa, Homo sapiens
MELGSCFKTYEDFKECFSAYKRENRCSFILRDCVSVRFHNLNHGTSIREDILYVQVKFVCIRTQSNRKRTREADMCPAYLLLRYNERLDRLFISELNTQHIHGDSKVASPGGDTTGKSQKTMCLQRLQPVQPTTKKDLDTAEKSLVEPSFCLDKVQVSSKPEQEGITPSDLAKIAKVMKNFLKVDEGSMASFSVGDSQHLDRLSFQSSKMTDLFIRFPENLLLHRVE

SEQ ID NO: 792521 - protein, 102 aa, Homo sapiens
MELGSCFKTYEDFKECFSAYKRENRCSFILRDCVSVRFHNLNHGTSIREDILKGGRGGAGQEGGEEAGPPEGCLEEEGCIGTHWAAWPFIQQALIEHLLCAL

SEQ ID NO: 792522 - protein, 115 aa, Homo sapiens
PGVLWRSLCLGGSGVGLRRCVCKKRPACSHILSSRVRLAARGSAGSPGHRTWLCVQRTLISTVAPREPPWRSPGQLGQSLPGAGRGSPGVCFPEFTGNGVTSTHAWVVSGVGSLC

SEQ ID NO: 792523 - protein, 109 aa, Homo sapiens [sequence omitted]

SEQ ID NO: 792524 - protein, 238 aa, Homo sapiens
MMCVVLTTLPCLTFSIAVTEVQKSINGSADVLPDMLPDLPVSLVLLSLIMVDIIEKLRIYPLRGSQKSSENGHIHSTSLQHIKTVTEQVRQSPENAASPQATNSTQVSQPSGAMTRSQESVFMGPQEPSCDSGILRMMSRRDVRAELFLWSFLLWSDTIEMVRVAGHPNVYKSSWLYPVYIFSFISLLRITFTPQNPLLNSLSVLLQDLPFVFVRLGLIIALGTITPVLGLCKNILVT

SEQ ID NO: 792525 - protein, 105 aa, Homo sapiens
PAACCTMKSAKLGFLLRFFIFCSLNTLLLGGVNKIAEKICGDLKDPCKLDMNFGSCYEVHFRYFYNRTSKRCETFVFSGCNGNLNNFKLKIEREVACVAKYKPPR

SEQ ID NO: 792526 - protein, 103 aa, Homo sapiens
MVGASRSASNQVCLDYLSLQNLALCLSHTSHSINSPPTPLSTYDLPQSSGTSSNVIVYYILYIIHCFVVYNLSIIQIRNIPRAENVPNALWCLHPTGLSIVIF

SEQ ID NO: 792527 - protein, 106 aa, Homo sapiens [sequence omitted]

SEQ ID NO: 792528 - protein, 109 aa, Homo sapiens
VLSKWCVDKCFVCIVLYLFHCALEENSSCTESLLWILVLRIRLNFGKKTSESIQRKLSSKQQSKQYTDMAKSWNVGWAWRLMPVILAFWEAEARGSLEVKSLRSAWPTW

SEQ ID NO: 792529 - protein, 84 aa, Homo sapiens
FSPGVTRSDKAFSIVCVRERKDGRWTFNPNCGALDERSPSNVIAKSETYREMGIKSSHHSRCYKAFPSRCYRFYSPEHRRKVRH

SEQ ID NO: 792530 - protein, 112 aa, Homo sapiens
SPMQGSQLSPLLTQFLFPHFNISEMTIHDIINGILQLLPAEQQSWYTSHPGGVNLAVSLADIIGQLQPLDVSISKLFKSHLRKENKPYLFPENILLISSGKVKKVPASKLAE

SEQ ID NO: 792531 - protein, 206 aa, Homo sapiens
AASLAGRWPLPRGKAGARAEARGAHGGRGARAGAGGAPRSRRAPRAAGNPTPRARLSGWKLRNAFCVDKFSRGAGRPLCGAVHRSVEPFPPRSRSLVPALQRREGNPEGTRSAHPVCRGAGIARRRLGWGPVLRVLGALEQITFPSAGRGSQPGAFPAAAAQTDGACFLLPPRGGDRASPISKPIFSQRREAIKVASGDSGNLYKE

SEQ ID NO: 792532 - protein, 103 aa, Homo sapiens
TPLSPGLSSTPPSSPSELLWTLQRRLVSRKPSKMSCWVRSPSLCPKPLEVPISAPVTLWFMVTHLASCLTGRSAPGGQGGVWLICECPGPLQALSSHSPVFVS

SEQ ID NO: 792533 - protein, 119 aa, Homo sapiens
PFYSPIHIPPDRSSLTSFTQSSLQNSTHSFQYLSPLLCSLLGRQAQFLPFGTIPPSSGFSGLIMYPFSITKAKLESSLEHRPGQETAQIEQREKGGSEHSCINCFGLITVSFFFFLSFL

SEQ ID NO: 792534 - protein, 108 aa, Homo sapiens
EWASYSCPEEVLSVLKQDRSDSTVNPSSIQKPTYSLYFLDHLVKALQKMCLHELTVPVLQLGVLISDSVVGSKGLSDLYHLRWVQLLFRSVISPKQNKNKQHVKVLIL

SEQ ID NO: 792535 - protein, 157 aa, Homo sapiens
PRVRRGGGHPLWRRTPKRVPSTSPSCWLAGSEMKGERWWLQGSATATSQACQREWLAESVSRPAALGKSHCPRSLGQLGEQCRVCCLGVPGLRGGWHMVGSGLELGWSEGALTRSPEGRLQTSPQILMPGYRAEGSLKSTGSPCSTWESPSHHLSWN

SEQ ID NO: 792536 - protein, 125 aa, Homo sapiens
MKGERWWLQGSATATSQACQREWLAESVSRPAALGKSHCPRSLGQLGEQCRVCCLGVPGLRGGWHMVGSGLELGWSEGALTRSPEGRLQTSPQILMPGYRAEGSLKSTGSPCSTWESPSHHLSWN

SEQ ID NO: 792537 - protein, 85 aa, Homo sapiens
PLTGSVYLLLLPSPTSSSSSAGGDLHDLKDSTPQGGSPWKAQQESRQRRDVMGASGIPSNLHSPRSQPDRQLSQAGENGSLEPCK

SEQ ID NO: 792538 - protein, 101 aa, Homo sapiens
LAYSGMLSAHCNLCPLNLWYSPCLILNFKRQSHTALGERTRWGSDWSKDQVQECPGSWTMASPQAHAPRSPGLASSLLDLFPQGYYCSISVIPPFIHGRDS

SEQ ID NO: 792539 - protein, 149 aa, Homo sapiens
MGSLLSASSRQCRRRGLAAPCPGCGPGAQSAMSLACAPPRSVRAPVMHPQGSCNRGPHTGGLQTTEMHPCTLPEARSPKASAGLTPSGVSEGEFHSIRSQLLLAPALLCLWTLQSTLPLLSHGFSLLRTLVIEFTALPTSEQSHRNILN

SEQ ID NO: 792540 - protein, 53 aa, Homo sapiens
MNPVAQQKLNFLKVLDAKVQNRHHLADKVLGAMPDPETTGEQLSVGLPAPAAA

SEQ ID NO: 792541 - protein, 79 aa, Homo sapiens
MSEILPYSEDKMGRFGADPEGSDLSFSCRLQDTNSFFAGNQAKRPPKLGQIGRAKRVVIEDDRIDDVLKGMGEKPPSGV

SEQ ID NO: 792542 - protein, 136 aa, Homo sapiens [sequence omitted]

SEQ ID NO: 792543 - protein, 136 aa, Homo sapiens [sequence omitted]

SEQ ID NO: 792544 - protein, 84 aa, Homo sapiens
QDDPKEQKGPVMAAMGGLTEPVPTLDLGKKLSVPQDLMMEELSLRNNRGSLLFQKRQRRVQKFTFELAASQRAVSKPPLCSWGK

SEQ ID NO: 792545 - protein, 174 aa, Homo sapiens
PVPDPAAAEMLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 792546 - protein, 174 aa, Homo sapiens; identical to SEQ ID NO: 792545

SEQ ID NO: 792547 - protein, 163 aa, Homo sapiens
MWLVFHRPHPRPSWPLRAALGFGRRQSSLRCFPVLPSARPYVSANPTLRGGRLRQDPESETGVGDLPDPVTTLVLLHNRLPLAVTVGCLPSRCPTEKRALPWQGLLHCLAVDVEVGQESEEKTERREVEPTSEKRGGKFRWEVDGSEEFEQTPTVKESDLSKQ

SEQ ID NO: 792548 - protein, 169 aa, Homo sapiens
ASCVRMGRGFGGRVTSGGSRDAVPGAEPPKMAVCIAVIAKENYPLYIRSTPTENELKFHYMVHTSLDVVDEKISAMGKALVDQRELYLGLLYPTEDYKVYGYVTNSKVKFVMVVDSSNTALRDNEIRSMFRKLHNSYTDVMCNPFYNPGDRIQSRAFDNMVTSMMIQVC

SEQ ID NO: 792549 - protein, 134 aa, Homo sapiens
ASCVRMGRGFGGRVTSGGSRDAVPGAEPPKMAVCIAVIAKENYPLYIRSTPTENELKFHYMVHTSLDVVDEKISAMGKALVDQRELYLGLLYPTEDYKVYLSGQGVCQGGPTVARCTLGSDNLKPFRRKRGESF

SEQ ID NO: 792550 - protein, 169 aa, Homo sapiens; identical to SEQ ID NO: 792548

SEQ ID NO: 792551 - protein, 155 aa, Homo sapiens
ASCVRMGRGFGGRVTSGGSRDAVPGAEPPKMAVCIAVIAKENYPLYIRSTPTENELKFHYMVHTSLDVVDEKISAMGKALVDQREYGYVTNSKVKFVMVVDSSNTALRDNEIRSMFRKLHNSYTDVMCNPFYNPGDRIQSRAFDNMVTSMMIQVC

SEQ ID NO: 792552 - protein, 112 aa, Homo sapiens
CHQQCLLQPTALFSSLPASSPPQQELFSPHSPLHHSFFLLSSLDSTFFLTLSLAQASSHPLCLPLSSPHRAETLGPSFFFSWALNRVLDQKIAEALAFFSLIPPWVPNSVLP

SEQ ID NO: 792553 - protein, 113 aa, Homo sapiens
RVEVSTPFHGDCQEPYAINDSKVPSQTQEHKPSTQNLQLQKDELDRQNPKRINAVSHLPSRTPLIQTKKSTSSSSSEFEDLNAYASQRNFYKRNLNRYCQERWPFQPCLTGRP

SEQ ID NO: 792554 - protein, 73 aa, Homo sapiens
FVQNRKKWPRQKDLLAMGSYRRFGRGEEYYINALGEADPMIPPPQSISNRHLEFRFRNPCPSFLCLQQQPTKT

SEQ ID NO: 792555 - protein, 181 aa, Homo sapiens
MRRSPSGLKSPRVSQGRKPRDPESLLFLRCCLGSEPHNLSSLLSPEAGQEPLPKLLPQPLAGHAAWGIHGVPTSLLLAGECWGQGMAVPADPPPASPYRTSPRPPPGPLPRYRPQQHLLLPLGRLHALCPGCPLQQSLQFERGTLSAPRLWSWMKLETIILSKLSQGQKTKHRMFSLISES

SEQ ID NO: 792556 - protein, 117 aa, Homo sapiens
CSQIVITGSHSQLHLWCLGWETRQLRAGADRSPLALPHLHVASLQCPQHGCFRVYRPVHGSQGYLDMCPKGRRGPGRGCIVIVPALESRQHHLLIIVFTGAETETLPDSRFWKSMWR

SEQ ID NO: 792557 - protein, 104 aa, Homo sapiens
RQKKKGRREERKEEKDKSSKDIEEQFIHPSVYLSIHSFLRQISAEFLSSTILGTKDITVNKRKLPAADPQHFQVTLVCAYVSVCVHVGASPLSAQACCQGTCLP

SEQ ID NO: 792558 - protein, 80 aa, Homo sapiens
LQCASFWKCLLEMERGDLQSSSLQKTACSAVRQLDSKSLAKSFQGAKQMAAPSTAAANSFIFGLFPGTRGARGWLTAVYL

SEQ ID NO: 792559 - protein, 367 aa, Homo sapiens
MSGKDEQQEQTIAEDLVVTKYKMEGDIANRGTSVLGGSISSGVSVLSLCEKGDAVIMEETGKIFKKEKEMKKGIAFPTSISVNNCVCHFSPLKSNQDYILKEGDLVKIELGVHVDGFIANVAHTFVVDVAQGTKYTGRKADVIKAAHLCAEAALRLVKPGNQNTQVTQAWNKVAHSFNCTPVEGMLSHQLKQHVIDGEKTIIQNPTDQQKKDHEKAEFDIHKVYAVDVLVSSGEGKPKDAGQRTTIYKQDPSKQYGLKMKTSRAFFSEVETRFDAMPFTLRAFEDEKKAQMGVVECAKHELLQPFNVLYEKEGEFVAQFKFTVLLMPSGPMRITSGPFEPDLCKSEMEVQDAELKALLQSSTSRKTQ

SEQ ID NO: 792560 - protein, 75 aa, Homo sapiens
ISTVGYGDMYPETHLGRFFAFLCIAFGIILNGMPISILYNKFSDYYSKLKAYEYTHHTQGEGRGELHAESQKEDS

SEQ ID NO: 792561 - protein, 77 aa, Homo sapiens
CNPYNAGRNKVKSAAQSDAPGKYQDQERKGIPVHPSNANRGNGPRGNDAAATASPGDLLATEVLRLRHRTTESEILE

SEQ ID NO: 792562 - protein, 142 aa, Homo sapiens
FSPESVSFTYRLQRPCKTLMRHIHWVHEALPVSPSTGAERELIPSLGGAQEAENLLPVSTPRFQITPFPAYCRGQQGPLPDPLAWASALVIVGPEWPRILAPAPPVWSLALLALPENGKAGLFTGHGARSALKNKEQIKCHK

SEQ ID NO: 792563 - protein, 232 aa, Homo sapiens
PYHPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATRLAERP

SEQ ID NO: 792564 - protein, 169 aa, Homo sapiens
PYHPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEGGRYAVGALCHRVGGCGHKTRRAAA

SEQ ID NO: 792565 - protein, 98 aa, Homo sapiens
ATSVPVATQCHVLPDAEGLHSWGSGGRKTVRCLLLSMPSHRMRGTGLIPQKPQPKKLRAREDPAHTGLGWASRSTGGASYHLCSEAWALCRCPLLCCN

SEQ ID NO: 792566 - protein, 144 aa, Homo sapiens
MVAKDIHMPKHLELSDKNVSNLPVIKAMQSLKSRGYVKAQFAWRHFYWYLPNEGIQYLRDYLHLPPEIVPATLCRSRPGTGRPRPKGLKGERPARLTRGKADRDTYRRSAVPPGADKKAEAGTGSATEFQFRGEFGHGHGRPPQ

SEQ ID NO: 792567 - protein, 643 aa, Homo sapiens
MLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTSIAECCSTPYSLLGLVFTVSFVALGVLTLCKFYLQGYRAFMNDPAMNRGMTEGVTLLILAVQTGLIELQVVHRAFLLSIILFIVVASILQSMLEIADPIVLALGASRDKSLWKHFRAVSLCLFLLVFPAYMAYMICQFFHMDFWLLIIISSSILTSLQVLGTLFIYVLFMVEEFRKEPVENMDDVIYYVNGTYRLLEFLVALCVVAYGVSETIFGEWTVMGSMIIFIHSYYNVWLRAQLGWKSFLLRRDAVNKIKSLPIATKEQLEKHNDICAICYQDMKSAVITPCSHFFHAGCLKKWLYVQETCPLCHCHLKNSSQLPGLGTEAVLQTHAGAEQNVMFQEGTEPPGQEHTPGTRIQEGSRDNNEYIARRPDNQEGAFDPKEYPHSAKDEAHPVESA

SEQ ID NO: 792568 - protein, 643 aa, Homo sapiens; identical to SEQ ID NO: 792567

SEQ ID NO: 792569 - protein, 643 aa, Homo sapiens; identical to SEQ ID NO: 792567

SEQ ID NO: 792570 - protein, 80 aa, Homo sapiens
PAVLTGLIELQVVLRAFLLSIILLGVVASMNDPAINRGMTEGVTLLILAVQTGLIELQVVHRAFLLSIILFIVVKFCNVC

SEQ ID NO: 792571 - protein, 643 aa, Homo sapiens; identical to SEQ ID NO: 792567

SEQ ID NO: 792572 - protein, 246 aa, Homo sapiens
MLLDVLYRWDVSSFFQQIQRSSLSNNPLFQYKYLALNMHYVGYILSVVLLTLPRQHLVQLYLYFLTALLLYAGHQISRDYVRSELEFAYEGPMYLEPLSMNRFTTALIGQLVVCTLCSCVMKTKQIWLFSAHMLPLLARLCLVPLETIVIINKFAMIFTGLEVLYFLGSNLLVPYNLAKSAYRELVQVVEVYGLLALGMSLWNQLVVPVLFMVFWLVLFALQIYSYFSTRDQPASRERLLFLFLTR

SEQ ID NO: 792573 - protein, 118 aa, Homo sapiens
NETKTWFFENTNTIDRPLGRLTMKRREKNQVSSSRNETGDITTDTTEIQKIIQGYYEHLYAHKLESLEEIDKFQEIYNPLKLNKGDIKFLNRSKTSSKIEIVIKKLSAKKSRTRQIHR

SEQ ID NO: 792574 - protein, 105 aa, Homo sapiens
GLMGRLKPAVRSSSGHSRQQERPAGGAGSIGPGLESELPSEAQLLSGPPQTGLCSWAGQDPAAWAFCLPAAPALSWRGKWASLPSVHAQDVALGLNGDVIFYTNP

SEQ ID NO: 792575 - protein, 109 aa, Homo sapiens
MTVEFLAVPITPQHDACQNAPNLLPDAGAIAISGHRQLRAALSNGCPWDTSLRDAFVGKGFCGSITFGSAAHLSPSWTFTKAVIAVKALTSPIEKLLAKPSLTHVFKLI

SEQ ID NO: 792576 - protein, 157 aa, Homo sapiens
PLMQFGPSFLQPANLETRTWIFIGRLGDFLTALGLCEKGPGLSLQKPTCYWLARTVSTFRHQLHPNTLCCIYNHGAFPRDAHLTASWPLRPGCTAWTIALRQRQCLSLYVLLPLVEMWLGHLEWGRRQVAWASWRLAAPMAESSATHPDVSTPLSCP

SEQ ID NO: 792577 - protein, 109 aa, Homo sapiens
MNPGSEKDSRLPRAAQPSRNVRRPRVKTQRTGSWWRGWCSGGWPCPQLMPQAQHLEKVLPPGLVLPRGPESRGKSRAGSMGTCSSSLGLARGQGSCVCSGWNLTPFGMD

SEQ ID NO: 792578 - protein, 66 aa, Homo sapiens
PNGDSNKSALETAIKKHFNEDIQCSDVSPGAPDSITQEFRSGLNLSAPPAPPHRPVSSWFRIARGR

SEQ ID NO: 792579 - protein, 129 aa, Homo sapiens
LSRCYNPLTLAASVSLKHLNFCPLQPSLLVLHTFWFALSPDLCGLAPPSHLGLSLNVTSLEESFLITLPKETYPRLPYPIPCFFLQTPLSEMISFLCQLSDFPLARKLHESQDHFIHTVSPAYRAVLGT

SEQ ID NO: 792580 - protein, 365 aa, Homo sapiens
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 792581 - protein, 329 aa, Homo sapiens
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKGDRFYSFSG

SEQ ID NO: 792582 - protein, 273 aa, Homo sapiens
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 792583 - protein, 140 aa, Homo sapiens
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFGMAMCPMLGTEGAS

SEQ ID NO: 792584 - protein, 117 aa, Homo sapiens
VARGCPGRRTPDPSASSWSTSLLPLPYPRTVSWSAGGWTRSAAFATGLFSSHFLWDLGLPNRRWMVCQRILSPPTANLQSQAGCSPEALGGRPLPAAGIWGRGTAFGVGNEVLVLHI

SEQ ID NO: 792585 - protein, 118 aa, Homo sapiens
PVLQNCEVQARDWQIQCLVSIHLLVHTWSPLALSSHSERGMRVLSCRIRHEEAAVMEGAGAGSGFRKELVSRLLHLHFKDDKTKEAAVRGVRQAQAEDALRVDVDQLEKVLPQLLLDF

SEQ ID NO: 792586 - protein, 168 aa, Homo sapiens
AFLLGTPQRHGRAHGHTHTPWARTDTDTEAQVRSVNWQSLRHSGLRRQMSTDRHRPSRAIGDRHKSTAGRPRDPLRGTPRRGQNVLKDTLLPRASLWSTWGHAHGRLHGRQEAPAHLAPPAFPYGARAECACVPVRAATCGRRGARCARGCPPSAARGELLPWRAERG

SEQ ID NO: 792587 - protein, 102 aa, Homo sapiens
KKKKKKKRTMATDSCSPLPQQMHFPKNREKCNPFGFLSSLSIALGNHVKTHMAGAYSDKPNNAHRWLPCESSQTTQECAGSNPPRPPPKQNLFKTANCSAAL

SEQ ID NO: 792588 - protein, 107 aa, Homo sapiens
SVTQAGVQWHDLSSPQPPSLGFKPFSSQVAGIIGMSNHSQLIFVFLVETGFHHGGHAGLELLTSSYLPASASQSAGITGMSHHAGPNSYFLLTSKWYIARMINDEGL

SEQ ID NO: 792589 - protein, 47 aa, Homo sapiens
MPEYCPQAERRLQRGAGFQQARLTRSLAFPVLALGRPRCCFPLGASF

SEQ ID NO: 792590 - protein, 103 aa, Homo sapiens
MTIVDIICCTAFQAQNISREKTNLPQSPLYVILQEGSKLYLLASFSIFQVLISLLSKALNHFCYINAIGLYFSFPNLYLYSYYNHTQQTKNCFLGLPLLEGGG

SEQ ID NO: 792591 - protein, 130 aa, Homo sapiens
QPMKLPGIPNPKSSLPFVKTLDTLSGLLKVALTTTSSILFSEPARPPASLEDKFPEERPCLLCPALTGCSRSLMVWGPFKGFPPTHLPMLLPPHGISSPHPTTRLPDEFPCLARLPIPHDPSDRFSVTDT

SEQ ID NO: 792592 - protein, 117 aa, Homo sapiens
SKPNPSPPIKQINGNKIILTYLRQPTYCSYCRKFIWGVFGKQGYQCQVCTCVTHKHCHHLTITACICQNNINQEDSKIAKQRFRINISHNFSIHNYKSLPLCNHCGALLWGIMGLHF

SEQ ID NO: 792593 - protein, 188 aa, Homo sapiens
STTSQQVKLIALTQTLTLAKGLRVNIYTDSKYAFHILHHHTVIWAERGFLTTQGSSIINASLIKTLLKATLLPKEAGFIHCKGHQKASDPIAQGNTYADKVAKKAASIPTSVPHGQFFSFSSVTPTYSPTETSTYQSLPTQGKWFLDQGKYLLPASQAHSILSSFHSLFHVGYKPLAHLLEPLISFPS

SEQ ID NO: 792594 - protein, 83 aa, Homo sapiens
LAGDLNGKTQDSGFHTGKGSAVEPYPCDETIGLLINYKNSCRIRHELVSSFFFFFFSKVFASCLFLKRNYFLTHIFMFHSSGT

SEQ ID NO: 792595 - protein, 111 aa, Homo sapiens
PTLASQSGGMTGVSHHAWPMPLLLVFSLRSKRGNLHSHAPAKKVPFHAVTCPTAAVFTELHAESLTASGLTKCLKGKADKPTWLSLARPVCALGLGHKLENKIEKETNIFF

SEQ ID NO: 792596 - protein, 135 aa, Homo sapiens
PDLAPVGWVGASAVSLLTPAAFPGPGSLSPAFKDSFSFQAPCRLSSLWRADTPPARGRTRAEGPGFQTGRRLSAIQPARPQLSCSQPDVSQGCHSHSKASRTQYQPHQVLLPCRPALGPHAHPTALALPATGSSR

SEQ ID NO: 792597 - protein, 331 aa, Homo sapiens
FCFSSFVFLALFPAVFFTHLVVSVSLLPDGVWFRLRSFVARCPPGLGSLALSASPPFPAPLKIFGYNAPPGPWARYNCTVRLLDDSEYTLHHPERCQGQYLLTFFATIVDLLEKDYFGIRFVDPDKQRHWLEFDKVCGETIEIQPPFTMCFRVKFYPADPAALKEEMTGIKSSCRSKGISTMADSSVKHPDAALLAAYIIQAEIGDYDSGKHPEGYSSKFQFFPKHSEKLERKIAEIHKTELSGQTPATSELNFLRKAQTLETYGVDPHPCKDVSGNAAFLAFTPFGFVVLQGNKRVHFIKWNEVTKLKFEGKTFYLYVSQKKKGIGSCPV

SEQ ID NO: 792598 - protein, 102 aa, Homo sapiens
MAWLCVSTQISSQFVIPVYQERKAIGSLGWFLSCCFCDSDEFSKDLIFFYKCLTFPLFAYFLLPPYEKGPCFPFAFCHDCKFTEVSLAMWNYESIKPFCLIN

SEQ ID NO: 792599 - protein, 131 aa, Homo sapiens
MGEGDGSKTTSTLPDPSKLAVLPVTCRSSHLPGLSIRPHLSRGPPQFSIPEASWWLTPSRPRRDFSPVPRTSPDLSDLPCPFPQRALPFSPVPKLHASRVSLRPFAALRPLGSAAGLFGPAPGGESSPARP

SEQ ID NO: 792600 - protein, 79 aa, Homo sapiens
RHGQSANKKLREIIEGTAMLFAPGQIWVEVDQGLPGCANSLHEPCSRAPDSIPHPWEVPVAITENFPETAISPECNLLG

SEQ ID NO: 792601 - protein, 79 aa, Homo sapiens
LGGPERGAAGLQPGNPERKRVLCKMGLHPCPAPSSMGSDAKTEAQGSEVTHPRSHSLSVAELGFNPREKPMQCCTSNHY

SEQ ID NO: 792602 - protein, 138 aa, Homo sapiens [sequence omitted]

SEQ ID NO: 792603 - protein, 1278 aa, Homo sapiens
KAAKIMMGKVDTFLDSLKKFDKEHIPEACLKAFKPYQGNPTFDPEFIRSKSTAAAGLCSWCINIVRFYEVYCDVAPKRQALEEANAELAEAQEKLSRIKNKIAELNANLSNLTSAFEKATAEKIKCQQEADATNRVILLANRLVGGLASENIRWAESVENFRSQGVTLCGDVLLISAFVSYVGYFTKKYRNELMEKFWIPYIHNLKVPIPITNGLDPLSLLTDDADVATWNNQGLPSDRMSTENATILGNTERWPLIVDAQLQGIKWIKNKYRSELKAIRLGQKSYLDVIEQAISEGDTLLIENIGETVDPVLDPLLGRNTIKKGKYIKIGDKEVEYHPKFRLILHTKYFNPHYKPEMQAQCTLINFLVTRDGLEDQLLAAVVAKERPDLEQLKANLTKSQNEFKIVLKELEDSLLARLSAASGNFLGDTALVENLETTKHTASEIEEKVVEAKITEVKINEARENYRPAAERASLLYFILNDLNKINPVYQFSLKAFNVVFEKAIQRTTPANEVKQRVINLTDEITYSVYMYTARGLFERDKLIFLAQVTFQVLSMKKELNPVELDFLLRFPFKAGVVSPVDFLQHQGWGGIKALSEMDEFKNLDSDIEGSAKRWKKLVESEAPEKEIFPKEWKNKTALQKLCMVRCLRPDRMTYAIKNFVEEKMGSKFVEGRSVEFSKSYEESSPSTSIFFILSPGVDPLKDVEALGKKLGFTIDNGKLHNVSLGQGQEVVAENALDVAAEKGHWVILQNIHLVARWLGTLDKKLERYSTGSHEDYRVFISAEPAPSPETHIIPQGILENAIKITNEPPTGMHANLHKALDLFTQDTLEMCTKEMEFKCMLFALCYFHAVVAERRKFGAQGWNRSYPFNNGDLTISINVLYNYLEANPKVPWDDLRYLFGEIMYGGHITDDWDRRLCRTYLAEYIRTEMLEGDVLLAPGFQIPPNLDYKGYHEYIDENLPPESPYLYGLHPNAEIGFLTVTSEKLFRTVLEMQPKETDSGAGTGVSREEKVKAVLDDILEKIPETFNMAEIMAKAAEKTPYVVVAFQECERMNILTNEMRRSLKELNLGLKGELTITTDVEDLSTALFYDTVPDTWVARAYPSMMGLAAWYADLLLRIRELEAWTTDFALPTTVWLAGFFNPQSFLTAIMQSMARKNEWPLDKMCLSVEVTKKNREDMTAPPREGSYVYGLFMEGARWDTQTGVIAEARLKELTPAMPVIFIKAIPVDRMETKNIYECPVYKTRIRGPTYVWTFNLKTKEKAAKWILAAVALLLQV

SEQ ID NO: 792604 - protein, 464 aa, Homo sapiens
MQPQGRGNGIFLYVAGSTGGSPQRGLGNKWDLYRQQGVGERSGKECLTNRTWVSACTALPMLTNCPLFQGYHEYIDENLPPESPYLYGLHPNAEIGFLTVTSEKLFRTVLEMQPKETDSGAGTGVSREEKAGSLKLLPSERKGEDLELRRGSQGLAAVQGNLLVRYTLPQPWAWVSETLGYGPQAGQQVLRRGSCRLRVKAVLDDILEKIPETFNMAEIMAKAAEKTPYVVVAFQECERMNILTNEMRRSLKELNLGLKGELTITTDVEDLSTALFYDTVPDTWVARAYPSMMGLAAWYADLLLRIRELEAWTTDFALPTTVWLAGFFNPQSFLTAIMQSMARKNEWPLDKMCLSVEVTKKNREDMTAPPREGSYVYGLFMEGARWDTQTGVIAEARLKELTPAMPVIFIKAIPVDRMETKNIYECPVYKTRIRGPTYVWTFNLKTKEKAAKWILAAVALLLQV

SEQ ID NO: 792605 - protein, 949 aa, Homo sapiens
MSLGGGQAEGFGQGSQGRTEYRQRGVNPAAKMSLITQGKSRCISQKGPRHRPGRRNRQGEVQCSSRDQKGGFKVAAWPGAGVKGGLYLCSSPLVTGRPTEPFPPPTARYIKIGDKEVEYHPKFRLILHTKYFNPHYKPEMQAQCTLINFLVTRDGLEDQLLAAVVAKERPDLEQLKANLTKSQNEFKIVLKELEDSLLARLSAASGNFLGDTALVENLETTKHTASEIEEKVVEAKITEVKINEARENYRPAAERASLLYFILNDLNKINPVYQFSLKAFNVVFEKAIQRTTPANEVKQRVINLTDEITYSVYMYTARGLFERDKLIFLAQVTFQVLSMKKELNPVELDFLLRFPFKAGVVSPVDFLQHQGWGGIKALSEMDEFKNLDSDIEGSAKRWKKLVESEAPEKEIFPKEWKNKTALQKLCMVRCLRPDRMTYAIKKKTRVYHDNGKLHNVSLGQGQEVVAENALDVAAEKGHWVILQNIHLVARWLGTLDKKLERYSTGSHEDYRVFISAEPAPSPETHIIPQGILENAIKITNEPPTGMHANLHKALDLFTQDTLEMCTKEMEFKCMLFALCYFHAVVAERRKFGAQGWNRSYPFNNGDLTISINVLYNYLEANPKVPWDDLRYLFGEIMYGGHITDDWDRRLCRTYLAEYIRTEMLEGDVLLAPGFQIPPNLDYKVKAVLDDILEKIPETFNMAEIMAKAAEKTPYVVVAFQECERMNILTNEMRRSLKELNLGLKGELTITTDVEDLSTALFYDTVPDTWVARAYPSMMGLAAWYADLLLRIRELEAWTTDFALPTTVWLAGFFNPQSFLTAIMQSMARKNEWPLDKMCLSVEVTKKNREDMTAPPREGSYVYGLFMEGARWDTQTGVIAEARLKELTPAMPVIFIKAIPVDRMETKNIYECPVYKTRIRGPTYVWTFNLKTKEKAAKWILAAVALLLQV

SEQ ID NO: 792606 - protein, 141 aa, Homo sapiens
MQAHNYKGLLFQLLAAGLKPFGVEPISAEGGECEDPTLPASPSLTYWQQHLTLSHTVPAGARWDTQTGVIAEARLKELTPAMPVIFIKAIPVDRMETKNIYECPVYKTRIRGPTYVWTFNLKTKEKAAKWILAAVALLLQV

SEQ ID NO: 792607 - protein, 163 aa, Homo sapiens
HLLMALPICCVIHTPFVCVEVVEAKITEVKINEARENYRPAAERASLLYFILNDLNKINPVYQFSLKVRPAAGAGCLPQGGAASGLHSQACCPHSHRAVPGPPSEGRPGPACRWSWKRGSQGPPSVLHPFSPGEGMSCSLLPALPLVPPGTHNPIKTNWMAWH

SEQ ID NO: 792608 - protein, 396 aa, Homo sapiens
MQPQGRGNGIFLYVAGSTGGSPQRGLGNKWDLYRQQGVGERSGKECLTNRTWVSACTALPMLTNCPLFQGYHEYIDENLPPESPYLYGLHPNAEIGFLTVTSEKLFRTVLEMQPKETDSGAGTGVSREEKVKAVLDDILEKIPETFNMAEIMAKAAEKTPYVVVAFQECERMNILTNEMRRSLKELNLGLKGELTITTDVEDLSTALFYDTVPDTWVARAYPSMMGLAAWYADLLLRIRELEAWTTDFALPTTVWLAGFFNPQSFLTAIMQSMARKNEWPLDKMCLSVEVTKKNREDMTAPPREGSYVYGLFMEGARWDTQTGVIAEARLKELTPAMPVIFIKAIPVDRMETKNIYECPVYKTRIRGPTYVWTFNLKTKEKAAKWILAAVALLLQV

SEQ ID NO: 792609 - protein, 1010 aa, Homo sapiens
MSLGGGQAEGFGQGSQGRTEYRQRGVNPAAKMSLITQGKSRCISQKGPRHRPGRRNRQGEVQCSSRDQKGGFKVAAWPGAGVKGGLYLCSSPLVTGRPTEPFPPPTARYIKIGDKEVEYHPKFRLILHTKYFNPHYKPEMQAQCTLINFLVTRDGLEDQLLAAVVAKERPDLEQLKANLTKSQNEFKIVLKELEDSLLARLSAASGNFLGDTALVENLETTKHTASEIEEKVVEAKITEVKINEARENYRPAAERASLLYFILNDLNKINPVYQFSLKAFNVVFEKAIQRTTPANEVKQRVINLTDEITYSVYMYTARGLFERDKLIFLAQVTFQVLSMKKELNPVELDFLLRFPFKAGVVSPVDFLQHQGWGGIKALSEMDEFKNLDSDIEGSAKRWKKLVESEAPEKEIFPKEWKNKTALQKLCMVRCLRPDRMTYAIKKKTRVYHDNGKLHNVSLGQGQEVVAENALDVAAEKGHWVILQNIHLVARWLGTLDKKLERYSTGSHEDYRVFISAEPAPSPETHIIPQGILENAIKITNEPPTGMHANLHKALDLFTQDTLEMCTKEMEFKCMLFALCYFHAVVAERRKFGAQGWNRSYPFNNGDLTISINVLYNYLEANPKVPWDDLRYLFGEIMYGGHITDDWDRRLCRTYLAEYIRTEMLEGDVLLAPGFQIPPNLDYKGYHEYIDENLPPESPYLYGLHPNAEIGFLTVTSEKLFRTVLEMQPKETDSGAGTGVSREEKVKAVLDDILEKIPETFNMAEIMAKAAEKTPYVVVAFQECERMNILTNEMRRSLKELNLGLKGELTITTDVEDLSTALFYDTVPDTWVARAYPSMMGLAAWYADLLLRIRELEAWTTDFALPTTVWLAGFFNPQSFLTAIMQSMARKNEWPLDKMCLSVEVTKKNREDMTAPPREGSYVYGLFMEGARWDTQTGVIAEARLKELTPAMPVIFIKAIPVDRMETKNIYECPVYKTRIRGPTYVWTFNLKTKEKAAKWILAAVALLLQV

SEQ ID NO: 792610 - protein, 40 aa, Homo sapiens
MAWLPALAPATFLAVIATCMGSGGPGPPVPVLPPTVSVTG

SEQ ID NO: 792611 - protein, 125 aa, Homo sapiens
FFFFLFSICLVDFSPSLHFEPMGVIACEMGFLKTAYYWVLLFIKLATLCLLIGSFSPFTFKVSIDMCGFDPVIVLLAVFEKVDICSFIVFRDFFCPPLFEISVNHKSFPIENNVASERRWEHNRR

SEQ ID NO: 792612 - protein, 125 aa, Homo sapiens
CFGVVSEMEKAKLFLPTCSLPCLFASCCIWPLKGKVKGKRRLRGRTVCELGLTVFPRLKYSVVISVHCNFCLLSSSNPLASASQVAGTDYRHEPPHLANFFCIFVEKTVSPCCTELLLKSLFTSW

SEQ ID NO: 792613 - protein, 114 aa, Homo sapiens
MGVGESSCESPLPWSELELLLHALRASRLLVSCPWPVSSWLSSPHCLRPSLPSLWRPHSVASPSCCLPTRCSPCFLGRSWVSFTDRWAPPARGCQCTREQVQVIPNSPAYLHLG

SEQ ID NO: 792614 - protein, 118 aa, Homo sapiens
FSSFPSQDLWLAGHPTIFTWQCQASQATASVSPKGGPPTNVAKEHPVPSDLLLFPVGHLSPSTRHTLYGAKSSTTLVISGPKDKHRCIHWTHELVPGPLALQNTEEKPLDWDIELSLN

SEQ ID NO: 792615 - protein, 68 aa, Homo sapiens
RRWRPQPRSQRESSRGELAPGRADVEPARREGLRYRASSQPSRGAHSAARARLVGKQGNIAGWQPGRP

SEQ ID NO: 792616 - protein, 118 aa, Homo sapiens
MREAGPACERAVLPGDGPPSPCACVPSQPSSLLSTHDPAWGASDGSPAISCILQEHSLKIWVALLIYFPGMQWVLFPWYFLSSAAFPFQTTRRRRKASPRQHANTQQKKTPGFDSQSC

SEQ ID NO: 792617 - protein, 148 aa, Homo sapiens
IIHTGEKPYKCEECGKAFNLSSHLTTHKIIHTGEKPYKCEECGKAFNQSSTLSKHKVIHTGEKPYKCGECGKAFNQSSHLTTHKIIHTGEKPYKCEECGKAFNNSSILNRHKMIHTGEKFYKPESCDNACDNISNISKHKRNCAGEKT

SEQ ID NO: 792618 - protein, 103 aa, Homo sapiens
LQQDDAVVEGHAAAAAALLDVEPAEDVDDAHDHVVDDLLPLGHAEVRLPLDDPEGHDAPVGHDEDAKIELVDAGEEREGQAAGGNAEQVPQHLCHGALVGQRP

SEQ ID NO: 792619 - protein, 172 aa, Homo sapiens
PTPAASTMLPKFDPNEIKVVYLRCTGGEVGATSALAPKIGPLGLSPKKVGDDIAKAMGDWKGLRITVKLTIQNRQAQIEVVPSASAMIIKALKEPPRDRKKQKNIKHSGNITFDEIVNIARQMRHQSLARELSGTTKEILGTAQSVGCNVDGRHPHDIIDDINSGAVECPAS

SEQ ID NO: 792620 - protein, 173 aa, Homo sapiens
NWILRTASQRLHPHTTRMHRSGHLSWVTSLVAIGLGSGAACTERRPWAQRAAGAPGGSFTEAGLGLAPEPVRSGVGSGAGDSAMATAGAACVSAVAPSDPIGARDLSGAAAAGPGRTGEGDAGRHGDLGRRAGGGGHAGGSAGRGRGGHRAAEKVPMAWGSGARVGKTQDIAS

SEQ ID NO: 792621 - protein, 94 aa, Homo sapiens
HLLWAVTCPLRGLISLPAAQPKRAEPRCTEETEPKSLSVSDEWARYPSPEGWPGATCAHRAWGNLEYECHAAACGRHHRCHHAPGPPGNAALFP

SEQ ID NO: 792622 - protein, 79 aa, Homo sapiens
SCLLPVPENGVQGGGWRRVEEGTEEGCEVKGVGEKSRTDNAEQLIPENYKVGGFEGLKGCAQVCNGERGLPALCWAPGI

SEQ ID NO: 792623 - protein, 115 aa, Homo sapiens
SFLGWKQVQEAPLPISYAPFPLTLLSFDCSLPPSYAPLRPPSGCLFPPPTPPLRLLVKFHEMLEEHLLVGHPALCWASPSAPLTFLSTSRGLEGNRADEALHPPSTPYTHHHPMR

SEQ ID NO: 792624 - protein, 109 aa, Homo sapiens
SPASGFYNDAFSYPPCDNLPEHFIFHLLSSRGMIYIICSSKAGYKKNNPSDFLGAMMSSRTQIHLETFKCSWTTVYSLEAEGTQEYDTPPWQKTVQWSTKGSSSPSRFF

SEQ ID NO: 792625 - protein, 94 aa, Homo sapiens
MIHIMDTGQLWQRMRYPSVCALGKVSKIHRTVRKTRSRTVHGVLPLTLQRRKCKINLQMANKHMKTCSTSLIIRKIKITTTVRYHLTSITMVVL

SEQ ID NO: 792626 - protein, 81 aa, Homo sapiens
KDGFMATFILHLGISPSLTHMQAGNRQTLEKAALRTNYGCLVIGQSEVRAWNVWTSPMTSCVPVGACAVGSGKEAMGTEHS

SEQ ID NO: 792627 - protein, 102 aa, Homo sapiens
MVTLRPSGCCGLKASETAKIRPELEMPVRSVPSIEAAMEAMNVIGSPRVHVKWEEGWGLGLSTGCPPGFLLKSPTLDRSPSASTTPTSINTRPTAAEILSAL

SEQ ID NO: 792628 - protein, 236 aa, Homo sapiens
MLVRGWFSSGRRSAVCVLRGKMGKVRGLRARVHQAAVRPKGEAAPGPRAPCGGGEPSAGLGRGEDWAFINTNIFARTKIDPSALVQKLELDVRSVTSVRRGAEAKTVLPKKEKMKLRREQWLQKIEAIKLAEQKHREERRRRATVVVGDLHPLRDALPELLGLEAGSRRQARSRESNKPRPSELSRMSAAQRQQLLEEERTRFQELLASPAYRASPLVAIGQTLARQMQLEDGGQL

SEQ ID NO: 792629 - protein, 173 aa, Homo sapiens
MDWAFINTNIFARTKIDPSALVQKLELDVRSVTSVRRGAEAKTVLPKKEKMKLRREQWLQKIEAIKLAEQKHREERRRRATVVVGDLHPLRDALPELLGLEAGSRRQARSRESNKPRPSELSRMSAAQRQQLLEEERTRFQELLASPAYRASPLVAIGQTLARQMQLEDGGQL

SEQ ID NO: 792630 - protein, 111 aa, Homo sapiens
EKCQKNRNFMAGSLRETKQNITIMLQCILLRRACPWPQLPLLWIDNTFNTSVIHKLKSLGRAWWLTPVTSALCEAEAGGSRGQAIETILANMVKPCLLKYKKLAGRGGVCL

SEQ ID NO: 792631 - protein, 121 aa, Homo sapiens
PRVQTSNFPRECIRRFFPKRKCFVFDRPTNDKDLLANIEKVSEKQLDPKFQEQTNIFCSYIFTHARTKTLREGITVTGNRLGTLAVTYVEAINMSRDCAIALQPGQQSLGDRVRLCLKKLN

SEQ ID NO: 792632 - protein, 75 aa, Homo sapiens
RGQSLAVKSFSRRTPNSSSYCPSEPMMSTPPPARELLQPQPQPQALHYALANVQQVQIHQCHETGALCCVLCPVS

SEQ ID NO: 792633 - protein, 118 aa, Homo sapiens
ARAYQAGATAPAGAAPAARALGSQAAGAAAALVERRDPGRRAGRRRRAALWPARTTLGAPAAHVADPKARGQRRQQRQQQQKQQRQEQRQARHGLLRDSGGASASRSAPRPPSSHRSR

SEQ ID NO: 792634 - protein, 148 aa, Homo sapiens
MGSQDEWSLSFICDTLFLERCVEERREVMRGSEEEEKGKQRRKEGVKRKREENREEKSFCTAKETTIRVNRQPTQWEKIFATYSSDKGLISRIYNELKQIYKKKRNNSIKKWTKDMNRHLSKEDIYAAKKHMKKMLTITGHQRNANQN

SEQ ID NO: 792635 - protein, 78 aa, Homo sapiens
MCWRALNPRSFTPRALQIYPWSLTSQHESVTQSFQMDAGGVGAGGKGDVMTEAEIGAMHFEMEEEATSQGMQVPLESD

SEQ ID NO: 792636 - protein, 84 aa, Homo sapiens
RNWVDGVFHDPILRHSTLNQAWATAKGALLDPGPLGRSLGAGANVLTAPLARAFPPAVPQDAPAAGAARELLALPKAGGKPFCA

SEQ ID NO: 792637 - protein, 76 aa, Homo sapiens
WQAALHRTHSDIQLPACQPQCVVPSLTTLAPQHPSRRGFCLWSPGHQPRPAGCGPAVTWGNPANLTVQWAAATSLQ

SEQ ID NO: 792638 - protein, 110 aa, Homo sapiens
IQDWRGKKSYAYINRQWEKGTQHYSAYFYPNVLLFQKKLKMIEGNPATEKASSSSTLTLSSESFFKISQEVLLHNLLKQAISSGKAALQISANKLLFHLRNNLENKCTKA

SEQ ID NO: 792639 - protein, 167 aa, Homo sapiens
MNRPAPVEISYENMRFLITHNPTNATLNKFTEELKKYGVTTLVRVCDATYDKAPVEKEGIHVLDWPFDDGAPPPNQIVDDWLNLLKTKFREEPGCCVAVHCVAGLGRAPVLVALALIECGMKYEDAVQFIRQKRRGAFNSKQLLYLEKYRPKMRLRFRDTNGHCCVQ

SEQ ID NO: 792640 - protein, 133 aa, Homo sapiens
MNRPAPVEISYENMRFLITHNPTNATLNKFTEELKKYGVTTLVRVCDATYDKAPVEKEGIHVLDWPFDDGAPPPNQIVDDWLNLLKTKFREEPGCCVAVHCVAGLGRAPVLVALALIECVCVHAQCPSVSVPA

SEQ ID NO: 792641 - protein, 265 aa, Homo sapiens
AKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELVVFLPALCRKMGVPYCIIKGKARLGRLVHRKTCTTVAFTQVNSEDKGALAKLVEAIRTNYNDRYDEIRRHWGGNVLGPKSVARIAKLEKGKAKELATKLG

SEQ ID NO: 792642 - protein, 245 aa, Homo sapiens
AKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELVVFLPALFHRKTCTTVAFTQVNSEDKGALAKLVEAIRTNYNDRYDEIRRHWGGNVLGPKSVARIAKLEKGKAKELATKLG

SEQ ID NO: 792643 - protein, 210 aa, Homo sapiens
AKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAVHRKTCTTVAFTQVNSEDKGALAKLVEAIRTNYNDRYDEIRRHWGGNVLGPKSVARIAKLEKGKAKELATKLG

SEQ ID NO: 792644 - protein, 93 aa, Homo sapiens
VSIPERYVELDPEEPPSLEELQARYRKAEKIRNILARSSMCNLQPTSGQDQNSVADLDLQLQEQERIINISYALASEASQRSKQVAAQAVTDP

SEQ ID NO: 792645 - protein, 110 aa, Homo sapiens
GYRETDVLFFSILGGWFEQHLLTISLVGMFLLKTELGSHKMFLQYKVIIPLAFILLFSCSKCMHLSKRIWAAVQSERCQQRLPRPIQSSKSLFDLLFHTDSSDEHAHELT

SEQ ID NO: 792646 - protein, 34 aa, Homo sapiens
MTRSLFQVPAPRIPSSSPSRMPRSWASTDCALRP

SEQ ID NO: 792647 - protein, 111 aa, Homo sapiens
MALPRLTGALRSFSNVTKQDNYNEEVADLKIKRSKLHEQVLDLGLTWKKIIKFLNEKLEKSKMQSINEDLKDILHAAKQIVGTDNGREAIESGAAFLFMTFHLKDSVGHKE

SEQ ID NO: 792648 - protein, 111 aa, Homo sapiens
MALPRLTGALRSFSNVTKQDNYNEEVADLKIKRSKLHEQVLDLGLTWKKIIKFLNEKLEKSKMQSINEDLKDILHAAKQIEVNCPFQKRRLDGKEEDEKMSRASDRFRGLR

SEQ ID NO: 792649 - protein, 86 aa, Homo sapiens
LLFATKGKREASTHYTFGERTLSLNVLKPLALSCLLPLFAGTHAGCRQKSQSFKHVSSVYSLVLRNFCLGFKTAKGRKDRHQKCPS

SEQ ID NO: 792650 - protein, 279 aa, Homo sapiens
MGLSPGAEGEYALRLPRIPPPLPKPASRTAGTGPKDQPPALRRSAVPHSGLNSISPLELEESVGFAALVQLPAKQPPPGTLEQGRSIQQGEKAVVSLETTPSQKADWSSIPKPENEGKLIKQAAEGKPRPRPGDLIEIFRIGYEHWAIYVEDDCVVHLAPPSEEFEVGSITSIFSNRAVVKYSRLEDVLHGCSWKVNNKLDGTYLPLPVDKIIQRTKKMVNKIVQYSLIEGNCEHFVNGLRYGVPRSQQVEHALMEGAKAAGAVISAVVDSIKPKPITA

SEQ ID NO: 792651 - protein, 244 aa, Homo sapiens
MGLSPGAEGEYALRLPRIPPPLPKPASRTAGTGPKDQPPALRRSAVPHSGLNSISPLELRRIRGIRSVGPAPSQAASAGHIRTGQKHPARGKPRPRPGDLIEIFRIGYEHWAIYVEDDCVVHLAPPSEEFEVGSITSIFSNRAVVKYSRLEDVLHGCSWKVNNKLDGTYLPLPVDKIIQRTKKMVNKIVQYSLIEGNCEHFVNGLRYGVPRSQQVEHALMEGAKAAGAVISAVVDSIKPKPITA

SEQ ID NO: 792652 - protein, 98 aa, Homo sapiens
PTFVCLWSPGEEFEVGSITSIFSNRAVVKYSRLEDVLHGCSWKVNNKLDGTYLPLPVDKIIQRTKKMVNKIVQYSLIEGNCEHFVNGLRYGVPRSQQV

SEQ ID NO: 792653 - protein, 119 aa, Homo sapiens
MGLSPGAEGEYALRLPRIPPPLPKPASRTAGTGPKDQPPALRRSAVPHSEESVGFAALVQLPAKQPPPGTLEQGRSIQQGEKAVVSLETTPSQKADWSSIPKPENEGKLIKQAAEVLKF

SEQ ID NO: 792654 - protein, 250 aa, Homo sapiens
MGLSPGAEGEYALRLPRIPPPLPKPASRTAGTGPKDQPPALRRSAVPHSGLNSISPLELEESVGFAALVQLPAKQPPPGTLEQGRSIQQGEKAVVSLETTPSQKADWSSIPKPENEGKLIKQAAEGKPRPRPGDLIEIFRIGYEHWAIYVEDDCVVHLAPPSEEFEVGSITSIFSNRAVVKYSRLEDVLHGCSWKVNNKLDGTYLPLPVDKIIQRTKKMVNKIVQYSLIEGNCEHFVNGLRYGVPRSQQV

SEQ ID NO: 792655 - protein, 109 aa, Homo sapiens
LESVSGSQKRDPCLGFLGVCVGCWGRSSHTSLTRLPCLHVDMREAPSACLCACLSPLTVKSFSADTCFGILTPLLTSWLTLGRKFSLSPISKSECLLTSSHWASPIEGY

SEQ ID NO: 792656 - protein, 132 aa, Homo sapiens
MLSTVPVLSTTQQTEADAVVVTWRVWAYNPPLPATTHTHRRTHIHALAHTCTCTCTHITGYLLQHCVHAHTHPCTHTHAHTRARAHTHITGYVLQHCVQAHTHIHALTHTCTCTRTHITGYLLQHCVQAHTH

SEQ ID NO: 792657 - protein, 128 aa, Homo sapiens
MAVGTSALSKEPWWTLPENFHSPMVFHMEEDQEELIFGLDDTYLRCIELHSHTLIQLERCFTATGQTRVTVVGPPMAKQWLLLMFHCVGSQDSKCHARGLKMLERVRSQPLTNDDLVTSVSLPPYTGD

SEQ ID NO: 792658 - protein, 140 aa, Homo sapiens
EPVSFVHLELRCSAQSVGGGPQATNTLLPHIPFSSLELGPGPSPSQAQASTPPHSPVLPESQPLGSTQGCHSQSPAPASDLGQSLETQKREDKTMKVSHSRRHPAVSSASKNASQRAKLPAKDIWMELWRPLRAGTAKQL

SEQ ID NO: 792659 - protein, 90 aa, Homo sapiens
LCVSHPERDRVCLESEVMWPSPPGRTGCRSPWLSFTERADRNLHALREVWELRRVYLSNELSLLIIGTPYNSYSGRIASCELRNSSEQIT

SEQ ID NO: 792660 - protein, 74 aa, Homo sapiens
RSPNHFSTCASGPARDGERAGSARAARRGAGPRERCPPPRLEGGDNSPCRAALLDGVYPFKKNLGGGGVRQKGW

SEQ ID NO: 792661 - protein, 107 aa, Homo sapiens
ACRPTPNMFVGTQSEQAYQYRAIYHLFKPVVLSCRQFCPHTAPTRRRGHSEITGDIFLAVTTGEGATGIWWLEARAATLLTSQAKNYLTKNVNRLRKPVSKLLKAVN

SEQ ID NO: 792662 - protein, 283 aa, Homo sapiens
LLYHAQSLKPLANRHATASKNIFREDPIIAMVLNATKVFKYESSENEQRRMFHATVATQTQFFHVKVLNINLKRKFIKKRIIIISNYSKRNSLLEVNEASSVSEAGPDQTFEVPKDIIRRAKKIPKINILHKQTSGYIVYGLFMLHTKIVNRKTTIYEIQDKTGSMAVVGKGECHNIPCEKGDKLRLFCFRLRKRENMSKLMSEMHSFIQIQKNTNQRSHDSRSMALPQEQSQHPKPSEASTTLPESHLKTPQMPPTTPSSSSFTKVQYPGSHDSYLPNINYK

SEQ ID NO: 792663 - protein, 305 aa, Homo sapiens
LLYHAQSLKPLANRHATASKNIFREDPIIAMVLNATKVFKYESSENEQRRMFHATVATQTQFFHVKVLNINLKRKFIKKRIIIISNYSKRNSLLEVNEASSVSEAGPDQTFEVPKDIIRRAKKIPKINILHKQTSGYIVYGLFMLHTKIVNRKTTIYEIQDKTGSMAVVGKGECHNIPCEKGDKLRLFCFRLRKRENMSKLMSEMHSFIQIQKNTNQRSHDSRSMALPQEQSQHPKPSEASTTLPESHLKTPQMPPTTPSSSSFTKKDETHPGAQSSPANFRITSPTVAPPLSSDTSTNRHPAVP

SEQ ID NO: 792664 - protein, 274 aa, Homo sapiens
LLYHAQSLKPLANRHATASKNIFREDPIIAMVLNATKVFKYESSENEQRRMFHATVATQTQFFHVKVLNINLKRKFIKKRIIIISNYSKRNSLLEVNEASSVSEAGPDQTFEVPKDIIRRAKKIPKINILHKQTSGYIVYGLFMLHTKIVNRKTTIYEIQDKTGSMAVVGKGECHNIPCEKGDKLRLFCFRLRKRENMSKLMSEMHSFIQIQKNTNQRSHDSRSMALPQEQSQHPKPSEASTTLPESHLKTPQMPPTTPSSSSFTKVTKDKDIK

SEQ ID NO: 792665 - protein, 75 aa, Homo sapiens
GLTPLLMVSCGGIPCPKKYKIPKYTASDTGQTRWMVTYEPRVLPAREKGATCHSGPRRGALRHRGSQQPWGRQAL

SEQ ID NO: 792666 - protein, 120 aa, Homo sapiens
AAWLTVVAPYLRTVASQEWLGKEQMGVAESWQVQATRPHGPFLSADPTNEEQSTGSLSGPKLLTLSQAEGLTGCGTLAVTPQPPLCKVGLIAVPQGEMQPGHRPGLCEAQEPWGTVIVPV

SEQ ID NO: 792667 - protein, 129 aa, Homo sapiens
PGSQSPTGSTHSGWYPRAVSPAGAGEGRPGGWLVFGSGAQPQRPIAAASPSSPPACCVSAWLPVGSGAPAEGEVLIFRIPKAASARARGFPCPVPRVPASGAMPHNQPLATLLGFFLCIYLYVPNNMLL

SEQ ID NO: 792668 - protein, 123 aa, Homo sapiens
MGWGPPPNKNRRGNPGALRTTPNGGSGGLDGGLNTGAQGGQKINPPRVCSVESTSTVKQDREDIAERATTEERTTGSRATQANTQSRKKHGSHEVERRQKLTDEYERTHLNAEYKQLATEQTQ

SEQ ID NO: 792669 - protein, 38 aa, Homo sapiens
MAGFLPSQESSPHPGLRSPPPSAKCRSPADAPGVQGSP

SEQ ID NO: 792670 - protein, 102 aa, Homo sapiens
RCTWLMTVAPGSPELRFRDEGDVTSLPLGFPSSVAINGLVLSFIQYVLPGHRHKYPVLCETLGVLNTESHPGPRGVHSWGRCVNRVKGMASKSCAGKSGQLE

SEQ ID NO: 792671 - protein, 70 aa, Homo sapiens
MQGFSSPHLARATLAPFAGAAGACPFSSFSPSHSLRAKAWAPQPQPGDEWPPCLPQEPKLGSAKRGDRGR

SEQ ID NO: 792672 - protein, 104 aa, Homo sapiens
VGQCSLWMKSIISYSANLTSHSLFSVFCSEFFWLVTSCLLNVGTALIVHMLRTRGISQEPLEMLSWPPETEDEDGTCFHHPPPSLFPLVNFPNNFITLNDFIKL

SEQ ID NO: 792673 - protein, 109 aa, Homo sapiens
LSIQTQIMSVLYSNLLRVKAKILTRPNKIWPLYTSLISLTKLLLPFLPHQPHLFHSQSPNALESSVVPTYQSDSQLKTFAIALFSPRTSSHKPLYLHGTFSPSSALSLK

SEQ ID NO: 792674 - protein, 97 aa, Homo sapiens
SRRRKGYGESRQHCQSLWDKRAKWFLLVRMDARESSRTRVAIKGPCPSGHPSEYDDSNRKNQVLGSARGCISSARERDYNRGLQGAPKVSHLPPRRL

SEQ ID NO: 792675 - protein, 104 aa, Homo sapiens
MFPKQLPSKVQAEGGADQAGPSCNPNVGWSSAVGQEGSQLPELGRCPQGTSPWGRHPPRGRAGTSVLGGPGQDSCLPGHPGKTLSKRFNQLSFTPVNQSENKLQ

SEQ ID NO: 792676 - protein, 75 aa, Homo sapiens
RPTHGAHGQISMDFIPSEAHKNPGVSRNLGIRPACGKELPTLALVLAVSCTLVRMTCLWKGAVLCMSPGNCSTAQ

SEQ ID NO: 792677 - protein, 52 aa, Homo sapiens
EVSSGGNACSPLTSCHGLVLVHGLGVGDPCSRYYDRNLKRKRPKILEPNSSV

SEQ ID NO: 792678 - protein, 108 aa, Homo sapiens
MTAKKGQPYLPFGLEEGWKDCLSTDNRQVTCDSDVDTPAVTPAYVPAERPRAPAVNFLGRRPLESWCFHHSSSLAHSMTEQRCNLQQVPSFLSSLSPSFTSQYVVRIK

SEQ ID NO: 792679 - protein, 110 aa, Homo sapiens
QLHRNRSPTCLCIGCNRVKRQLGSLKMHLRRRKKKRDLVADRLGHREIQNEESLLESRQRQTEEGREKGNGEKRQTEEGKEGGKGAAREEVRKEMRNRERQNFKNLEKEV

SEQ ID NO: 792680 - protein, 91 aa, Homo sapiens
QGPEPEPMPERPGKPLTTVSLRILVCEMTVKTWLLPPLGSADEAHRHPGGVDNLLEVRMHNRAEFADTNWHSVQEDSPVLGSHFPLLKSVS

SEQ ID NO: 792681 - protein, 75 aa, Homo sapiens
LVAVASRVRNRDSPGVTNKPGLSNVERNQPATQGKGSSHTTVTRQLCAQTEEGNAWEPAKYFLGGWDRPSHIPNF

SEQ ID NO: 792682 - protein, 74 aa, Homo sapiens
QYRIDALPLTERPLIDSEGRMLTRMELGLGEWGRQAVTQQAVDQRGHIMDCAVGCEGNEQTEDAEQGTSSYHGH

SEQ ID NO: 792683 - protein, 109 aa, Homo sapiens
GASTKALQMGEAGALGKGKPAPWCPEGKAAGGPVYAGPCRVSGFTLRAEGKVLIITHCSLKLLGSGNPVSASWVVGTVGRHHHLCLIIIIIFFGETGSQYVAVSQRGRF

SEQ ID NO: 792684 - protein, 295 aa, Homo sapiens
RHQCSICLKAFARPWSLSRHRLVHSTDRPFVCPDCGLAFRLASYLRQHRRVHGPLSLLAPLPAAGKKDDKASGARNSAKGPEGGEGAECGGASEGGEGGQNGGDAAPARPPAGEPRFWCPECGKGFRRRAHLRQHGVTHSGARPFQCVRCQREFKRLADLARHAQVHAGGPAPHPCPRCPRRFSRAYSLLRHQRCHRAELERAAALQALQAQAPTSPPPPPPPLKAEQEEEGLPLPLANIKEEPPSPGTPPQSPPAPPVFLSASCFDSQDHSAFEMEEEEVDSKAHLRGLGGLAS

SEQ ID NO: 792685 - protein, 70 aa, Homo sapiens
QMGKLRPGNRERWDQGHMMAEGGQGRRLTAYPARVPCQACAGAKDRGLWTAPVAGSHAGRQGLCNQADRV

SEQ ID NO: 792686 - protein, 68 aa, Homo sapiens
SWAWRLPWEATAGSADALLQPELGLFSHWEKGCGSEELGCRNFGVYKRRRELSQKSLFAGRWEMQPGG

SEQ ID NO: 792687 - protein, 77 aa, Homo sapiens
NPWCHFPGDPGGGRGCRPAEIQSRIPTAKRLVCHLQAGERGALGLHHPELCNNLEHHRVFPEMGFSSPGWSRTPGLK

SEQ ID NO: 792688 - protein, 96 aa, Homo sapiens
NPWCHFPGDPGGGRGCRPAEIQSRIPTAKRLVCHLQAGERGALGLHHPELCNNLEHHRVFPGRHKSERDRAPWAAAAWPARCLARPRGAVMERTFG

SEQ ID NO: 792689 - protein, 124 aa, Homo sapiens
SSCAGLLEAQAGEGGRVWGRRAPLSLTQRSCVFLVKPSHARGPIASSPPSLPTNIPSPDPNSPPHYPALDLGNVFLYFNIAQGKNTYILRDLGWGKQKPCGVEKTKAYFYKCLMFSPPGCSETP

SEQ ID NO: 792690 - protein, 162 aa, Homo sapiens
SNFPLLLRQTSRLQHSLQAMHKLSPAQDSAPLSSHSRFHPFPPFLQQPKCLLLQAPPGLFHEVPSAPFLEEVSVPVTRSCCPPLHPGPDSKAAGSCPRRRGKGLSAPILRLENCHLLPPHRAQGAASEPGKGVSCRANYWHFLCDLEQATSPPFASVYSSLK

SEQ ID NO: 792691 - protein, 78 aa, Homo sapiens
KSVHKKNTIYEIQDNTGSMDVVGSGKWPNIKCEKGDKLRLFCLQLRTVDRKLKLVCGSHSFIKVIKAKKNKEGPMNVN

SEQ ID NO: 792692 - protein, 69 aa, Homo sapiens
KSVHKKNTIYEIQDNTGSMDVVGSGKWPNIKCEKGDKLRLFCLQLRTVDRKLKLVIKAKKNKEGPMNVN

SEQ ID NO: 792693 - protein, 158 aa, Homo sapiens
LRETRDALREKTLALGSVQLDLRQAQHRIKEMKQMHPNGEAKESQSIGKQNSLEERIRQQELENLLLERQLEDARKEGDNKEIVINIHRDCLENGKEDLLEERNKELMKEYNYLKEKLLQCEKEKAEREVSMKKTINFWKENLNISFWLYVEPSSIYK

SEQ ID NO: 792694 - protein, 109 aa, Homo sapiens
TPGKGGEELAGGSTQTPADVPDLDTQEVAGFLFLSPTFLFVCLRQSLALSPSLECKGVILAECNGMILAHCNLRLLRRENGVNPGGGACSEPRSRHCTPAWATERDSVS

SEQ ID NO: 792695 - protein, 404 aa, Homo sapiens
RRRGSIHQPAPRLQDRASVCMGVTGAHGFPCCGKGSVEVAEMRDDLSQHQIQEEQELEADMLEQKPQLQVDLDLDPDPDPDPELEIGQVPALLESELYPALKLEAELDTEANSNEESDFEEPMQLVCKIESVHSNMGLPTPQTFRPWSLNSNCRSFTEENHMSACHHSISAQTSKHLFWANKLIQASEHSLQRAINMQLNNGSAGQPIRSPLREAIPTNALCSEEQLQIPDAHSAPPTTSSQAPSPLLSSDLPPPIDLTELITFASSLAMASSSRMDLPSLEHMMKAPPQEALEPSTEPLLTTVEEREPENHAETLPEKPREARAPLKSWSQEDKNFAQSYFDFSKPGIKRATIKGQIQLLQPPATSPLLQGSKEDSVPPGKEKENPLLVKIHFKLSAPTIPEK

SEQ ID NO: 792696 - protein, 108 aa, Homo sapiens
VITRVLQHGVLKPTNSPYNSPILPVLKPDKPYKLVQDLRLINHIVLLPIHPMVPNPYTLLSSIPASTTHYSVLDLKHAFFTIPLHPSSQPLFAFTWTDPDTHQAQQIT

SEQ ID NO: 792697 - protein, 101 aa, Homo sapiens
LQHHEMPTWHLDVHAYVEARARAETPAQKPPRTPGLMYASAGRPPAPEDIRQVVPPGCQPSRPTWEPMWTSGLSAQAPASGGGVETSGAALSWWPNLPGKS

SEQ ID NO: 792698 - protein, 105 aa, Homo sapiens [sequence omitted]

SEQ ID NO: 792699 - protein, 69 aa, Homo sapiens
LEFCPSKERAMPEPTEVGSGAALEVRACNAHVNAKDGSFSASKKAVLNMRNTAASKTERCLLSGETTNR

SEQ ID NO: 792700 - protein, 721 aa, Homo sapiens
MAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVLAEAAAETSLEGGNMALAIFIPVLIISLLLGGAYIYITRCRYYSNLRLPLMYSHPYSQITVETEFDNPIYETGETREYEVSI

SEQ ID NO: 792701 - protein, 797 aa, Homo sapiens
MAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKVNQDSFEHALEVAEAAAETSLEGGNMALAIFIPVLIISLLLGGAYIYITRCRYYSNLRLPLMYSHPYSQITVETEFDNPIYETGETREYEVSI

SEQ ID NO: 792702 - protein, 1076 aa, Homo sapiens
RASAQGAPEAAPARGLLPRSRFPFLAHRRPPSPAPSPSARPTASGSAPPAATMPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKVNQDSFEHALEVAEAAAETSLEGGNMALAIFIPVLIISLLLGGAYIYITRCRYYSNLRLPLMYSHPYSQITVETEFDNPIYETGETREYEVSI

SEQ ID NO: 792703 - protein, 169 aa, Homo sapiens
ISSELLLACISAEESLACDNPGLPENGYQILYKRLYLPGESLTFMCYEGFELMGEVTIRCILGQPSHWNGPLPVCKVNQDSFEHALEVAEAAAETSLEGGNMALAIFIPVLIISLLLGGAYIYITRCRYYSNLRLPLMYSHPYSQITVETEFDNPIYETGETREYEVSI

SEQ ID NO: 792704 - protein, 1007 aa, Homo sapiens
RASAQGAPEAAPARGLLPRSRFPFLAHRRPPSPAPSPSARPTASGSAPPAATMPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVSEESLACDNPGLPENGYQILYKRLYLPGESLTFMCYEGFELMGEVTIRCILGQPSHWNGPLPVCKGKETYSPHRVHGAWRCQAPGSQEF

SEQ ID NO: 792705 - protein, 1001 aa, Homo sapiens
RASAQGAPEAAPARGLLPRSRFPFLAHRRPPSPAPSPSARPTASGSAPPAATMPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKTEESLACDNPGLPENGYQILYKRLYLPGESLTFMCYEGFELMGEVTIRCILGQPSHWNGPLPVCKVAEAAAETSLEGGNMALAIFIPVLIISLLLGGAYIYITRCRYYSNLRLPLMYSHPYSQITVETEFDNPIYETGETREYEVSI

SEQ ID NO: 792706 - protein, 721 aa, Homo sapiens; identical to SEQ ID NO: 792700

SEQ ID NO: 792707 - protein, 125 aa, Homo sapiens
MAWAFASNFLASFHANEVNSLYIDQCFLISLSVNQDSFEHALEVAEAAAETSLEGGNMALAIFIPVLIISLLLGGAYIYITRCRYYSNLRLPLMYSHPYSQITVETEFDNPIYETGETREYEVSI

SEQ ID NO: 792708 - protein, 878 aa, Homo sapiens
MPAARPPAAGLRGISLFLALLLGSPAAALERDALPEGDASPLGPYLLPSGAPERGSPGKEHPEERVVTAPPSSSQSAEVLGELVLDGTAPSAHHDIPALSPLLPEEARPKHALPPKKKLPSLKQVNSARKQLRPKATSAATVQRAGSQPASQGLDLLSSSTEKPGPPGDPDPIVASEEASEVPLWLDRKESAVPTTPAPLQISPFTSQPYVAHTLPQRPEPGEPGPDMAQEAPQEDTSPMALMDKGENELTGSASEESQETTTSTIITTTVITTEQAPALCSVSFSNPEGYIDSSDYPLLPLNNFLECTYNVTVYTGYGVELQVKSVNLSDGELLSIRGVDGPTLTVLANQTLLVEGQVIRSPTNTISVYFRTFQDDGLGTFQLHYQAFMLSCNFPRRPDSGDVTVMDLHSGGVAHFHCHLGYELQGAKMLTCINASKPHWSSQEPICSAPCGGAVHNATIGRVLSPSYPENTNGSQFCIWTIEAPEGQKLHLHFERLLLHDKDRMTVHSGQTNKSALLYDSLQTESVPFEGLLSEGNTIRIEFTSDQARAASTFNIRFEAFEKGHCYEPYIQNGNFTTSDPTYNIGTIVEFTCDPGHSLEQGPAIIECINVRDPYWNDTEPLCRAMCGGELSAVAGVVLSPNWPEPYVEGEDCIWKIHVGEEKRIFLDIQFLNLSNSDILTIYDGDEVMPHILGQYLGNSGPQKLYSSTPDLTIQFHSDPAGLIFGKGQGFIMNYIEVSRNDSCSDLPEIQNGWKTTSHTELVRGARITYQCDPGYDIVGSDTLTCQWDLSWSSDPPFCEKIMYCTDPGEVDHSTRLISDPVLLVGTTIQYTCNPGFVLEGSSLLTCYSRETGTPIWTSRLPHCVCESCLMNWAPSR

SEQ ID NO: 792709 - protein, 170 aa, Homo sapiens
TLTSNKDYSECGLQWCRLCFGGRVESPTTVLIGEPLGIPAPHFIPEIFYKVEDFLMFRCLDPKSPRTFVARPMANLLFSDCRGPVISPGQWPPSFQSRPPSKSLREAQAMSRIMARYSAALQARRCPPVSGGRLTNIGYFRTSHWSCHLGLFMHIQQENCIFMSNRPSPG

SEQ ID NO: 792710 - protein, 165 aa, Homo sapiens
RRLSRAFSSWLYSGSGPRGNRDRPRGSRRGGEAWDVERNPRGSGLYVSPFGALPSWGPSSSGSWLWAVRGKRSGFSGEVPCLHREGLHGRGPGSPGGPNADRVSLPEPGGGGLVWAAAVVIDVPSTCTATTSPSPGVFGLNFVRESTLGWNVCCWSRGRYLYSDT

SEQ ID NO: 792711 - protein, 113 aa, Homo sapiens
VTPCWPGWSQSLDLVIHLPWPPKMLGLQALATMPGLSYTFLVLEKKIFEARILHSSGLAFKYEKCNRNNLSRIKPQKGCHTKTLLKILATIIVGDFNTTFSMANITSRQKINK

SEQ ID NO: 792712 - protein, 106 aa, Homo sapiens
CSVKAMMGPDCLQAGRSSLGHTWSKSGDFPIWILLQWLCYTEKLLLSCHLPVVLSLSSLGGRGQLLSLRAEHASEPLPTLHLIFFFLLLEETQHFLWCFIAVDSRC

SEQ ID NO: 792713 - protein, 151 aa, Homo sapiens
LHVEGKAISDCRPSRPSHTLSSLATGASRGPPLSKAPTMDAQQDRPKSQDCLGLVAPLASAAEVSSTAPVSGKKHRPPGPLFSSSDPLPATSSHSGDSAQDTSLIPAPLTPASRDAGVRRMFCVRNCLRGLGLFLLVFSFLFLLTWASFSF

SEQ ID NO: 792714 - protein, 137 aa, Homo sapiens
GSLFCSDLCALFPEPAHTLEEQHNLPIIGAGNVDLAAGFGHSGSQTGCGSSKGAEKGLQNVDFYLCPRNHPNSSCRDSYQFFCPDWTCVTLATYSGGSTRSSTLSIACASCPKLWTKRNCNPLTITVHNPNLAQWNY

SEQ ID NO: 792715 - protein, 143 aa, Homo sapiens
VVNRTPTATASSTKQVNYLQTGSEGQRKPRLHDSLVPRGSGARPRADRVSRACPTCTTAEDSAVSSGFYMWWTRPGLVLQETPSGRDGNEARAVLGSFSVAQVVAFSGKNRNEARALSGSSSFLRMVHSDIVWLCVPTQLFSQ

SEQ ID NO: 792716 - protein, 221 aa, Homo sapiens
GRPAAAGPLLKRSHSVPAPSIRKQILEELEKPGAGDPDPSAPQGGPGSATSDLGMACDRARVFLHSDEHPGSSVASKSRKSVMVAEIPSTVSQHSESHTDETLASRKSDAIFRAAKKDLLTLMKLEDSSLLDGRVALLHVPAGTVVSRQGDQDASILFVVSGLLHVYQRKIGSQEDTCLFLTRPGEMVGQLAVLTGEPLIFTVKANRDCSFLSISKAHFYE

SEQ ID NO: 792717 - protein, 159 aa, Homo sapiens
GRPAAAGPLLKRSHSVPAPSIRKQILEELEKPGAGDPDPSAPQGGPGSATSDLGMACDRARVFLHSDEHPGSSVASKSRKSVMVAEIPSTVSQHSESHTDETLASRKSDAIFRAAKKDLLTLMKLEDSSLLDGRVALLHVPAGTVVSRQGDQTLPKCFQ

SEQ ID NO: 792718 - protein, 915 aa, Homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSPAAKKKYVSYNNLVI

SEQ ID NO: 792719 - protein, 707 aa, Homo sapiens
MVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSPAAKKKYVSYNNLVI

SEQ ID NO: 792720 - protein, 915 aa, Homo sapiens; identical to SEQ ID NO: 792718

SEQ ID NO: 792721 - protein, 705 aa, Homo sapiens
MVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNNFFFWLYSGTWITL

SEQ ID NO: 792722 - protein, 122 aa, Homo sapiens
RALVDGPCTQVRRQTMPFKCMQLTDFNLKFPHRAHQKYVRQAWQKANINTKWAATRWAKKIEARERKAKMTDFDHFKVMKAMRNRIIKNEVKKLQKAALQKLLPKKHLLRSVLLLLQLLLKF

SEQ ID NO: 792723 - protein, 117 aa, Homo sapiens
MMQQEAPGECFSPSLYYCHVLITVWWNLNDLLSRWINASFPVLEYRKWMDKQGLALLSRLECGSAITADCILNLSGSSSPPTSASQVAETVRACHNAQLIIWTFPIHGFQRADCETK

SEQ ID NO: 792724 - protein, 60 aa, Homo sapiens
SCLGHRQVSRNEAAVSQAGVQVTCEVVGPAAKHCLSPDSGHPSVEQGLQFPFQARGLHWL

SEQ ID NO: 792725 - protein, 109 aa, Homo sapiens
RWLLHQVPRHVRLGVPLVPEALWCRLAYPRSQGESVGPPWHWPWSQASETSRKRPADFSLAEMFLKYLTYGWARWLTPVIPTLWEAEAGGSRGQEIETILANMVKPRLY

SEQ ID NO: 792726 - protein, 105 aa, Homo sapiens
IFNLSTYKVTYSSVNWKCGYAGILVSDQMFEYLFLNGVGTSTARILKSTSAVGTGIMLSTCCRTGAGRELLQLWFLLGNKTGNQSQLTSWNWPLCVTAGCLSLQL

SEQ ID NO: 792727 - protein, 89 aa, Homo sapiens
RSWQVLTACRRLPSYLPVPSLGEKECDEGGEDQVSLLGPRLLRSFPGIFLIDCYVDHVLPSVLSRSDGQRENFCTCHVFVAKILVSSTL

SEQ ID NO: 792728 - protein, 80 aa, Homo sapiens
KIELQEIQPKEAKHIAEEADRKYEEVACKWVITEGDLERTENELSWQSPIAEEMDEQIRLMDQNLKCLSAAEENYSQDLC

SEQ ID NO: 792729 - protein, 159 aa, Homo sapiens
PRLQPPGVPSPHRPYLRSRLSLPLTIVQKCTRLPSLLKKLDFLKNNLRFTAKLRGRYREFPSPLEPPCHQHPAWGHISHHPGTCTDITSTESRADVRSPWWHSHRWTNSSIAAQEPCARPLLLPSSSPCSLRMVLPFPVRHAAELESHGLQPFQRGFST

SEQ ID NO: 792730 - protein, 115 aa, Homo sapiens
TPYHWCPRLHLCPEDTNAAVTGQINGDAFMGRRKTCPRGISPIQWEAVFQSVGDRKGRLSPCEGTFPSSHSISAPGGLASEFQREGWPFLSVLGVSWSQDPWETQIHQDACIRRT

SEQ ID NO: 792731 - protein, 166 aa, Homo sapiens
SALVAATGGDGGGGHATAAVTERLWWVGWEAGKCRGRSRHGPAATAAVSSLFPCVAAGVGGDGATLARPGCGLPGQRAGAGRTAPHRHVTMDCRTKANPDRTFDLVLKVKCHASENEEDSPAYLPRIPPGKVRRFAFCIKKLENFPVGPGVAPPVSGVDLVPAETA

SEQ ID NO: 792732 - protein, 214 aa, Homo sapiens
SALVAATGGDGGGGHATAAVTERLWWVGWEAGKCRGRSRHGPAATAAVSSLFPCVAAGVGGDGATLARPGCGLPGQRAGAGRTAPHRHVTMDCRTKANPDRTFDLVLKVKCHASENEDPVVLWKFPEDFGDQEILQSVPKFCFPFDVERVSQNQVGQHFTFVLTDIESKQRFGFCRLTSGGTICLCILRYDLNETLRSLYNHPVPKANTPVSLL

SEQ ID NO: 792733 - protein, 166 aa, Homo sapiens; identical to SEQ ID NO: 792731

SEQ ID NO: 792734 - protein, 121 aa, Homo sapiens
VIVASHAVWLFLLSQQKAFSALQSTNAWKVATLETISQILVTQWDYQLLPILVSPRRHSGANVHSWSDQWWPEESNCTNMAARGALCFGGSYRRRGIRIGTPALCSYRGSLPGCLYGELRS

SEQ ID NO: 792735 - protein, 104 aa, Homo sapiens
ITGVSHCAWPALTFLQGYTGPWLASKAGWCCVLTVSWAPAVWQPSEDTGRVGLALCLACSDHLVDEGTLPLSVPPSGLAEAGEPGQGQAPRDPLWTPGISQPFG

SEQ ID NO: 792736 - protein, 68 aa, Homo sapiens
TSPCLKKSFLAYSFLGPPPKSDFDYISLMVSTNSNLFYTVYIQPYLILKPSMPPGTVAHACNPSTLGV

SEQ ID NO: 792737 - protein, 66 aa, Homo sapiens
QITSGLTAVGGGVSSTPISSGEMEAHAASAEGEWSAQKTATDQEKLVVNKAHSLRNNLNKTRKIRA

SEQ ID NO: 792738 - protein, 104 aa, Homo sapiens
RRNLTLSPRLECSGVISAHCNLCLLSSSNFPASTSQVAEITGTHHHAWIIFVFLVETGFHHVGQAGLELMTSSDPPTLASQSAGITGVSTMLNGNYFLGMIHGT

SEQ ID NO: 792739 - protein, 172 aa, Homo sapiens
QYDNEKKWELICDQERFQVKNPPAAYIQKLKSYVDTGGVSRKFKRRVQESTQVLRELETSLRTNHIGWVQEFLNEENRGLDVLLEYLAFAQCSVTYDMESTDNGASNSEKNKPLEQSVEDLSKGPPSSVPKSRHLTIKYVGHKVGWWENREFSPHTAASSQPTPGPWGWREG

SEQ ID NO: 792740 - protein, 156 aa, Homo sapiens
MFMCCVCVCAHTLCLFVCVHVYTLCAHVSGVCVPCLSMYGGAHVACEFLFCWAGVWRWWGRLSMKGHLCQLEEGGRCCLLPQDLVGLWEAGLHPPAFPVLGPQFKRRVQESTQVLRELETSLRTNHIGWVQEFLNEENRGLDVLLEYLAFAQCSVT

SEQ ID NO: 792741 - protein, 101 aa, Homo sapiens
RNFCRLVKPLKPLWPRLAICAAVAALRMAEACSYWGIGWQACPLYPVLSPHIVAPTLSGRHLCFLPWPVSDSMTTQLWHFASWEPGTAGTLRTMGGSYWLG

SEQ ID NO: 792742 - protein, 138 aa, Homo sapiens
SFPCSLPLFSPVLWRSVLEVFMELPRVPLRKGHQQAQLTSHEQSWSPAWPGSCPAESCRGPRLWLSGRISSPNRRLHENRILQVSRKHQAMRMDGQQPGNFLSPICAGSWHRNNQDGKACGFLGFLKNYFRKEKKAQA

SEQ ID NO: 792743 - protein, 127 aa, Homo sapiens
VTYFSSTKNRVYNKSRVFRKRSFFMKSRALGHKSIPNSSKPLSLLLGPWVFLPMCIFPFSSVSPENSFCLSTFKLPLTNHHTQRDFSKVARQGTCSLLGSPCLWLNMGGTEVYFLLLKKKINSKLTV

SEQ ID NO: 792744 - protein, 125 aa, Homo sapiens
MAVEDSTLQVVVRVRPPTPRELDSQRRPVVQVVDERVLVFNPEEPDGGFPGLKWGGTHDGPKKKGKDLTFVFDRVFGEAATQQDVFQHTTHSVLDSFLQGYNCSVFAYGATGAGKTHTMLGREGD

SEQ ID NO: 792745 - protein, 409 aa, Homo sapiens
SQPCTPELPAGPRALQEESLGMEAQVERAMEGNSSDQEQSPEDEDEGPAEEVPTQMPEQNPTHALPESPRLTLQPKPVVGHFSARELDGDRSKQLALKVLCVAQRQYSLLQAANLLTPDMITEFETLQQLVQEEKIEPGAEALRTSGLARGAPLAQELCSESIPVPSPLCPEPPGYTGPVTRTMARRLSGPLHTLGIPPGPNCTPAQGSRWPMEKKRRRPSALEADSPMAPKRGTKRQRQSFLPCLRRGSLPDTQPSQGPSTPKGERASSPCHSPRVCPATVIKSRVPLGPSAMQNCSTPLALPTRDLNATFDLSEEPPSKPSFHECIGWDKIPQELSRLDQPFIPRAPVPLFTMKGPKPTSSLPGTSACKKKRVASSSVSHGRSRIARLPSSTLKRPAGPLVLPGDWH

SEQ ID NO: 792746 - protein, 440 aa, Homo sapiens
SQPCTPELPAGPRALQEESLGMEAQVERAMEGNSSDQEQSPEDEDEGPAEEVPTQMPEQNPTHALPESPRLTLQPKPVVGHFSARELDGDRSKQLALKVLCVAQRQYSLLQAANLLTPDMITEFETLQQLVQEEKIEPGAEALRTSGLARGAPLAQELCSESIPVPSPLCPEPPGYTGPVTRTMARRLSGPLHTLGIPPGPNCTPAQGSRWPMEKKRRRPSALEADSPMAPKRGTKRQRQSFLPCLRRGSLPDTQPSQGPSTPKGERASSPCHSPRVCPATVIKSRVPLGPSAMQNCSTPLALPTRDLNATFDLSEEPPSKPSFHECIGWDKIPQELSRLDQPFIPRAPVPLFTMKGPKPTSSLPGTSACKKKRVASSSVSHGRSRIARLPSSTLKRPAGPLVLPELPLSPLCPSNRRNGKDLIRVGRALSAGNGVTKVS

SEQ ID NO: 792747 - protein, 409 aa, Homo sapiens; identical to SEQ ID NO: 792745

SEQ ID NO: 792748 - protein, 336 aa, Homo sapiens
SQPCTPELPAGPRALQEESLGMEAQVERAMEGNSSDQEQSPEDEDEGPAEEVPTQMPEQNPTHALPESPRLTLQPKPVVGHFSARELDGDRSKQLALKVLCVAQRQYSLLQAANLLTPDMITEFETLQQLVQEEKIEPGAEALRTSGLARGAPLAQELCSESIPVPSPLCPEPPGYTGPVTRTMARRLSGPLHTLGIPPGPNCTPAQGSRWPMEKKRRRPSALEADSPMAPKRGTKRQRQSFLPCLRRGSLPDTQPSQGPSTPKGERASSPCHSPRVCPATVIKSRVPLGPSAMQNCSTPLALPTRDLNATFDLSEEPPSKPSFHECIGWDKIPQD

SEQ ID NO: 792749 - protein, 114 aa, Homo sapiens
GALSPGVGTAVCGVAVGPVSKQRRQRRRTEKGVTTVMAVEDSTLQVVVRVRPPTPRELDSQRRPVVQVVDERVLVFNPEEPDGGFPGLKWGGTHDRPPPQQHFEEASWAPCTPR

SEQ ID NO: 792750 - protein, 409 aa, Homo sapiens; identical to SEQ ID NO: 792745

SEQ ID NO: 792751 - protein, 409 aa, Homo sapiens; identical to SEQ ID NO: 792745

SEQ ID NO: 792752 - protein, 154 aa, Homo sapiens
TFFPMENQKIESSPGERYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEV

SEQ ID NO: 792753 - protein, 86 aa, Homo sapiens
RCQCPGTGFANPGSRVPESSPLSALKTSFVGLTSGSTLPTGELKLFPRRGKLPNDRGIKDFPSGFVAISNSNDMKKCSPSLRREGG

SEQ ID NO: 792754 - protein, 107 aa, Homo sapiens
LSVTSLDPGSLRCPVCLSMEGCLEGTTEEICPKGTTHCYDGLLRLRGGGIFSNLRVQGCMPQPVCNLLNGTQEIGPVGMTENCDMKDFLTCHRGTTIMTHGNLAACI

SEQ ID NO: 792755 - protein, 300 aa, Homo sapiens
MDLPPQLSFGLYVAAFALGFPLNVLAIRGATAHARLRLTPSLVYALNLGCSDLLLTVSLPLKAVEALASGAWPLPASLCPVFAVAHFFPLYAGGGFLAALSAGRYLGAAFPLGYQAFRRPCYSWGVCAAIWALVLCHLGLVFGLEAPGGWLDHSNTSLGINTPVNGSPVCLEAWDPASAGPARFSLSLLLFFLPLAITAFCYVGCLRALARSGLTHRRKLRAAWVAGGALLTLLLCVGPYNASNVASFLYPNLGGSWRKLGLITGAWSVVLNPLVTGYLGRGPGLKTVCAARTQGGKSQK

SEQ ID NO: 792756 - protein, 186 aa, Homo sapiens
RGEREEEKKRHSYFEKPKVHDESVDVDKGPGSAKELIKSINEKFAGSAGWEGTESLKIAEDKKQLRDFFGMSNSYAECYPATMDDMAVDSDEEVDYSKMDQGNKKRTLSRWDFDTQEDYSEYMNNKEALPKAAFQYGIKMSEGRKTRRFKETNDKAALDCQWKISAIIEKRKKMEADGVEVKRPKY

SEQ ID NO: 792757 - protein, 67 aa, Homo sapiens
SQVLVPNKHLAPQIPSQNLLPENPIYTKTLMIPVISVIPAEVPLVSEAILDQQTSCASSNIKNNQLR

SEQ ID NO: 792758 - protein, 217 aa, Homo sapiens
ETEFRSCCPGCSGNGAILAHCNLRLLGSSDSPVSASRVAGITGMCHHAGLIFVFLVETGFHHVGQAGLQLLTLGDPPASASQSAGITGVSHRARPVTGIFNGVLPFLALFHITTGHHIYFLPYFLASQKIGRALPEQCRARIPDFLGYLISTSRNVGSYPLFLLFLPKKGENSSHIYIVGLAFQSKAKLNSVDFAWESSGPLVLETSLNCEELLICR

SEQ ID NO: 792759 - protein, 156 aa, Homo sapiens [sequence omitted]

SEQ ID NO: 792760 - protein, 156 aa, Homo sapiens [sequence omitted]

SEQ ID NO: 792761 - protein, 97 aa, Homo sapiens
MTHQPPPKAFYSAGGVGHRERHLQRLGERTREWAEGKALQWEGCDQRVLHAKRILRVDITNRKIVLAFLFVCRITVALKSTPSALQTLKKVSRWKNL

SEQ ID NO: 792762 - protein, 125 aa, Homo sapiens
MRGMMTASPPVSPEPPLQEKPVLPIRRLCRAWTRLFAGLLSHQHLPRVGPRESLQPSPAQASDREMQNLSVTIRAACALPVLQGWHWKKHLPPAGCSGSRLQSQHFGRPRWADHEVRKSSVDLSL

SEQ ID NO: 792763 - protein, 68 aa, Homo sapiens
GARRARGRRSFRWRDPAGMLPASASASALASGPPAHAGRPGPHLPLGTARPCPAALGAGVGVAERKSR

SEQ ID NO: 792764 - protein, 168 aa, Homo sapiens
QLLHADYEESLSGKNMFPQPSFGPNPFLGPVPIAPPFFPHVWHGYPFQGFIENPVMRQNIVLPSDEKGELDLSLENLDLSKDCGSVSTVDEFPAARSEHVHSLPEASVSSKPDEGRTEQSSQTRKADMALASIPPVAEGKAHPPTQILNREREKLCLLNLNLKGPFKV

SEQ ID NO: 792765 - protein, 80 aa, Homo sapiens
LTGKLKEPAGYLHMMELLETFEKPHSHSQDEKYTNLAPRFPYLVRTHRGGGQGTAVIIHLHTYRGNTASDAGHMPLSFLM

SEQ ID NO: 792766 - protein, 210 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSPFEKGV

SEQ ID NO: 792767 - protein, 72 aa, Homo sapiens
EEELGQINLTPGNHDSDEGILIRVMVSRSEIDLFNIRKEFRKNFATSLYSMIKGDTSGDYKKALLLLCGEDD

SEQ ID NO: 792768 - protein, 136 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYAQA

SEQ ID NO: 792769 - protein, 210 aa, Homo sapiens; identical to SEQ ID NO: 792766

SEQ ID NO: 792770 - protein, 210 aa, Homo sapiens; identical to SEQ ID NO: 792766

SEQ ID NO: 792771 - protein, 210 aa, Homo sapiens; identical to SEQ ID NO: 792766

SEQ ID NO: 792772 - protein, 210 aa, Homo sapiens; identical to SEQ ID NO: 792766

SEQ ID NO: 792773 - protein, 210 aa, Homo sapiens; identical to SEQ ID NO: 792766

SEQ ID NO: 792774 - protein, 210 aa, Homo sapiens; identical to SEQ ID NO: 792766

SEQ ID NO: 792775 - protein, 210 aa, Homo sapiens; identical to SEQ ID NO: 792766

SEQ ID NO: 792776 - protein, 210 aa, Homo sapiens; identical to SEQ ID NO: 792766

SEQ ID NO: 792777 - protein, 210 aa, Homo sapiens; identical to SEQ ID NO: 792766

SEQ ID NO: 792778 - protein, 210 aa, Homo sapiens; identical to SEQ ID NO: 792766

SEQ ID NO: 792779 - protein, 210 aa, Homo sapiens; identical to SEQ ID NO: 792766

SEQ ID NO: 792780 - protein, 283 aa, Homo sapiens
VDCFGWGRKGLGTDEESILTLLTSRSNAQRQEISAAFKTLFGRDLLDDLKSELTGKFEKLIVALMKPSRLYDAYGKVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSPFEKGV

SEQ ID NO: 792781 - protein, 210 aa, Homo sapiens; identical to SEQ ID NO: 792766

SEQ ID NO: 792782 - protein, 210 aa, Homo sapiens; identical to SEQ ID NO: 792766

SEQ ID NO: 792783 - protein, 183 aa, Homo sapiens
MAQVLRGTVTDFPGFDERADAETLRKAMKGLGTDEESILTLLTSRSNAQRQEISAAFKTLFGRDLLDDLKSELKGAGTNEKVLTEIIASRTPEELRAIKQVYEEEYGSSLEDDVVGDTSGYYQRMLVVLLQANRDPDAGIDEAQVEQDAQALFQAGELKWGTDEEKFITIFGTRSVSPFEKGV

SEQ ID NO: 792784 - protein, 188 aa, Homo sapiens
MAQAWKMTWWGTLQGTTSGCWWFSFRLTETLMLELMKLKLNKMLRLYFRLENLNGGQMKKSLSPSLEHEVCLHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 792785 - protein, 210 aa, Homo sapiens; identical to SEQ ID NO: 792766

SEQ ID NO: 792786 - protein, 302 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 792787 - protein, 163 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQVLRGD

SEQ ID NO: 792788 - protein, 293 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRIQGTTSGCWWFSFRLTETLMLELMKLKLNKMLRLYFRLENLNGGQMKKSLSPSLEHEVCLHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 792789 - protein, 210 aa, Homo sapiens; identical to SEQ ID NO: 792766

SEQ ID NO: 792790 - protein, 118 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRS

SEQ ID NO: 792791 - protein, 179 aa, Homo sapiens
SRYQTSVTSGCWWFSFRLTETLMLELMKLKLNKMLRLYFRLENLNGGQMKKSLSPSLEHEVCLHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 792792 - protein, 157 aa, Homo sapiens
MLELMKLKLNKMLRLYFRLENLNGGQMKKSLSPSLEHEVCLHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 792793 - protein, 189 aa, Homo sapiens
ASDAEVTLVDPRSPRGTTSGCWWFSFRLTETLMLELMKLKLNKMLRLYFRLENLNGGQMKKSLSPSLEHEVCLHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 792794 - protein, 210 aa, Homo sapiens; identical to SEQ ID NO: 792766

SEQ ID NO: 792795 - protein, 210 aa, Homo sapiens; identical to SEQ ID NO: 792766

SEQ ID NO: 792796 - protein, 153 aa, Homo sapiens
MKLKLNKMLRLYFRLENLNGGQMKKSLSPSLEHEVCLHLRKVFDKYMTISGFQIEETIDRETSGNLEQLLLAVVKSIRSIPAYLAETLYYAMKGAGTDDHTLIRVMVSRSEIDLFNIRKEFRKNFATSLYSMIKGDTSGDYKKALLLLCGEDD

SEQ ID NO: 792797 - protein, 153 aa, Homo sapiens; identical to SEQ ID NO: 792796

SEQ ID NO: 792798 - protein, 240 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALFQAGELKWGTDVFDKYMTISGFQIEETIDRETSGNLEQLLLAVGLTSGRSLGRILPPLFIP

SEQ ID NO: 792799 - protein, 193 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALISRLGETLNWGEQD

SEQ ID NO: 792800 - protein, 180 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQANRDPDAGIDEAQVEQDAQALF

SEQ ID NO: 792801 - protein, 70 aa, Homo sapiens
CCVYLEDPGFACSRGAGVSVAWISLGAAAGSFSVCISASPRVPSPGSPPLSRGFGALGSHSLVLLHLPLT

SEQ ID NO: 792802 - protein, 194 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSSLEDDVVGDTSGYYQRMLVVLLQLTETLDAWEFGMEKKPFKKGFFGKKNPKKGKNWGPF

SEQ ID NO: 792803 - protein, 217 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAIKQVYEEEYGSGRKITGGGATSRDNRGSAGDPQGTEPSRDWEPTLPSQGNQADTTGATKSPLGPGSPKGSHHSTRHHHTTHPRDPTPRGHTPG

SEQ ID NO: 792804 - protein, 119 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNDQVYEEEYGSSLG

SEQ ID NO: 792805 - protein, 90 aa, Homo sapiens
NHLSLFLLMFQDSVAFEDVAVSFTQEEWALLDPSQKNLYRDVMQETFKNLTSVGKTWKVQNIEDEYKNPRRNLRDGVSLFPRLVIDCWIM

SEQ ID NO: 792806 - protein, 132 aa, Homo sapiens
CLLIRAHYYLCESPTEGEAHSSFYFCCYAGCCRDTRFPTPRGPGSLCHNFCRSAACTVTRTIHGSPREDTGTPRSREMMFQDSVAFEDVAVSFTQEEWALLDPSQKNLYRDVMQETFKNLTSVGKNDNITSQ

SEQ ID NO: 792807 - protein, 609 aa, Homo sapiens
CLLIRAHYYLCESPTEGEAHSSFYFCCYAGCCRDTRFPTPRGPGSLCHNFCRSAACTVTRTIHGSPREDTGTPRSREMMFQDSVAFEDVAVSFTQEEWALLDPSQKNLYRDVMQETFKNLTSVGKTWKVQNIEDEYKNPRRNLSLMREKLCESKESHHCGESFNQIADDMLNRKTLPGITPCESSVCGEVGTGHSSLNTHIRADTGHKSSEYQEYGENPYRNKECKKAFSYLDSFQSHDKACTKEKPYDGKECTETFISHSCIQRHRVMHSGDGPYKCKFCGKAFYFLNLCLIHERIHTGVKPYKCKQCGKAFTRSTTLPVHERTHTGVNADECKECGNAFSFPSEIRRHKRSHTGEKPYECKQCGKVFISFSSIQYHKMTHTGEKPYECKQCGKAFRCGSHLQKHGRTHTGEKPYECRQCGKAFRCTSDLQRHEKTHTEDKPYGCKQCGKGFRCASQLQIHERTHSGEKPHECKECGKVFKYFSSLRIHERTHTGEKPHECKQCGKAFRYFSSLHIHERTHTGDKPYECKVCGKAFTCSSSIRYHERTHTGEKPYECKHCGKAFISNYIRYHERTHTGEKPYQCKQCGKAFIRASSCREHERTHTINR

SEQ ID NO: 792808 - protein, 609 aa, Homo sapiens; identical to SEQ ID NO: 792807

SEQ ID NO: 792809 - protein, 531 aa, Homo sapiens
MFQDSVAFEDVAVSFTQEEWALLDPSQKNLYRDVMQETFKNLTSVGKTWKVQNIEDEYKNPRRNLSLMREKLCESKESHHCGESFNQIADDMLNRKTLPGITPCESSVCGEVGTGHSSLNTHIRADTGHKSSEYQEYGENPYRNKECKKAFSYLDSFQSHDKACTKEKPYDGKECTETFISHSCIQRHRVMHSGDGPYKCKFCGKAFYFLNLCLIHERIHTGVKPYKCKQCGKAFTRSTTLPVHERTHTGVNADECKECGNAFSFPSEIRRHKRSHTGEKPYECKQCGKVFISFSSIQYHKMTHTGEKPYECKQCGKAFRCGSHLQKHGRTHTGEKPYECRQCGKAFRCTSDLQRHEKTHTEDKPYGCKQCGKGFRCASQLQIHERTHSGEKPHECKECGKVFKYFSSLRIHERTHTGEKPHECKQCGKAFRYFSSLHIHERTHTGDKPYECKVCGKAFTCSSSIRYHERTHTGEKPYECKHCGKAFISNYIRYHERTHTGEKPYQCKQCGKAFIRASSCREHERTHTINR

SEQ ID NO: 792810 - protein, 609 aa, Homo sapiens; identical to SEQ ID NO: 792807

SEQ ID NO: 792811 - protein, 160 aa, Homo sapiens
CLLIRAHYYLCESPTEGEAHSSFYFCCYAGCCRDTRFPTPRGPGSLCHNFCRSAACTVTRTIHGSPREDTGTPRSREMMFQDSVAFEDVAVSFTQEEWALLDPSQKNLYRDVMQETFKNLTSVGKTWKVQNIEDEYKNPRRNLRDGVSLFPRLVIDCWIM

SEQ ID NO: 792812 - protein, 107 aa, Homo sapiens
SWGLWGKTATSQKPLAKVYGRSSALRCPKPSYKVGKINIFEEDQEQGKRDLTIEVCTSIPQGSPRAVVLTPEHQHLLGTCQKCKFSSLSQDLLNQKLWRVGPSPLLS

SEQ ID NO: 792813 - protein, 101 aa, Homo sapiens
WSVSLSPRLECSGVISVHCNLHLPGSSNPPTSASQVARTTGLCYHAWLICFVFSVEMAFHHVGQAGLELLVSSDPPTSASESAGITGVSHCARSKSALLGV

SEQ ID NO: 792814 - protein, 108 aa, Homo sapiens
MYGGEKRLPSKIFILCSLSRAVRHQILASAEGGDTGESLTCKIKLSLERERVSLVHRSVANAASSVPAPAHHWENHEPTLSVSPLSLSVSSLGLSCHQYTDSDSQIFP

SEQ ID NO: 792815 - protein, 691 aa, Homo sapiens
MFNCRLALKQENEEKRNADMLYNKDSEQLRIKEEECGKVVETKQQLKWNLRRLVKELRTVRNNLDLVVQERNDAQKQLSEEQDARILQDQILTSKQKELEMARKKMNSEISHRHQKEKDLFHEDCMLQEEIALLRLEIDTIKNQNKQKEKKYFEDIEAVKEKNDNLQKIIKLNEETLTETILQYSGQLNNLTAENKILNSELENGKQNQERLEIEMESYRCRLAAAVRDCDQSQTARDLKLDFQRTRQEWVRLHDKMKVDMSGLQAKNEILSEKLSNAESKINSLQIQLHNTRDALGRESLILERVQRDLSQTQCQKKETEQMYQIEQSKLKKYIAKQESVEERLSQLQSENMLLRQQLDDAHKKANSQEKTSSTIQDQFHSAAKNLQAESEKQILSLQEKNKELMDEYNHLKERMDQCEKEKAGRKIDLTEAQETVPSRCLHLDAENEVLQLQQTLFSMKAIQKQCETLQKNKKQLKQEVVNLKSYMERNMLERGKAEWHKLLIEERARKEIEEKLNEAILTLQKQAAVSHEQLVQLREDNTTSIKTQMELTIKDLESEISRIKTSQADFNKTELERYKELYLEEVKVRESLSNELSRTNEMIAEVSTQLTVEKEQTRSRSLFTAYATRPVLESPCVGNLNDSEGLNRKHIPRKKRSALKDMESYLLKVSYLFSFGVQISDRILVCYLVK

SEQ ID NO: 792816 - protein, 733 aa, Homo sapiens
MFNCRLALKQENEEKRNADMLYNKDSEQLRIKEEECGKVVETKQQLKWNLRRLVKELRTVRNNLDLVVQERNDAQKQLSEEQDARILQDQILTSKQKELEMARKKMNSEISHRHQKEKDLFHEDCMLQEEIALLRLEIDTIKNQNKQKEKKYFEDIEAVKEKNDNLQKIIKLNEETLTETILQYSGQLNNLTAENKILNSELENGKQNQERLEIEMESYRCRLAAAVRDCDQSQTARDLKLDFQRTRQEWVRLHDKMKVDMSGLQAKNEILSEKLSNAESKINSLQIQLHNTRDALGRESLILERVQRDLSQTQCQKKETEQMYQIEQSKLKKYIAKQESVEERLSQLQSENMLLRQQLDDAHKKANSQEKTSSTIQDQFHSAAKNLQAESEKQILSLQEKNKELMDEYNHLKERMDQCEKEKAGRKIDLTEAQETVPSRCLHLDAENEVLQLQQTLFSMKAIQKQCETLQKNKKQLKQEVVNLKSYMERNMLERGKAEWHKLLIEERARKEIEEKLNEAILTLQKQAAVSHEQLVQLREDNTTSIKTQMELTIKDLESEISRIKTSQADFNKTELERYKELYLEEVKVRESLSNELSRTNEMIAEVSTQLTVEKEQTRSRSLFTAYATRPVLESPCVGNLNDSEGLNRKHIPRKKRSALKDMESYLLKMQQKLQNDLTAEVAAATKYEPGSYIASPLGFTHKENLNQDPVLEVTKDAGITSVSYHTQRGSQV

SEQ ID NO: 792817 - protein, 728 aa, Homo sapiens
MFNCRLALKQENEEKRNADMLYNKDSEQLRIKEEECGKVVETKQQLKWNLRRLVKELRTVRNNLDLVVQERNDAQKQLSEEQDARILQDQILTSKQKELEMARKKMNSEISHRHQKEKDLFHEDCMLQEEIALLRLEIDTIKNQNKQKEKKYFEDIEAVKEKNDNLQKIIKLNEETLTETILQYSGQLNNLTAENKILNSELENGKQNQERLEIEMESYRCRLAAAVRDCDQSQTARDLKLDFQRTRQEWVRLHDKMKVDMSGLQAKNEILSEKLSNAESKINSLQIQLHNTRDALGRESLILERVQRDLSQTQCQKKETEQMYQIEQSKLKKYIAKQESVEERLSQLQSENMLLRQQLDDAHKKANSQEKTSSTIQDQFHSAAKNLQAESEKQILSLQEKNKELMDEYNHLKERMDQCEKEKAGRKIDLTEAQETVPSRCLHLDAENEVLQLQQTLFSMKAIQKQCETLQKNKKQLKQEVVNLKSYMERNMLERGKAEWHKLLIEERARKEIEEKLNEAILTLQKQAAVSHEQLVQLREDNTTSIKTQMELTIKDLESEISRIKTSQADFNKTELERYKELYLEEVKVRESLSNELSRTNEMIAEVSTQLTVEKEQTRSRSLFTAYATRPVLESPCVGNLNDSEGLNRKHIPRKKRSALKDMESYLLKMQQKLQNDLTAEVAAATKYEPGSYIASPLGFTHKENLNQDPVLEVTKEYAQILRRKYIL

SEQ ID NO: 792818 - protein, 56 aa, Homo sapiens
MFVNEAVCRWAKKGVCVSTIPHQRNQISLEKWIPLLEQEKDKMNLEHLVTEFKRCS

SEQ ID NO: 792819 - protein, 73 aa, Homo sapiens
QTKEGPAEQTVRRPRPDPHTKVQDLSLGRQRRDLLNRRCGGQGQIHAQRMSLVGPTPGGIACKKQGSSWPSAV

SEQ ID NO: 792820 - protein, 135 aa, Homo sapiens
MFSEVPRSHEAGADSQGNGTAVSLFFLVLCIHALLHPCPFTLPTHIPLDWPCGQSLECMGCWGPVGCTGPEPLAPSRLAWSQQVGDLSRACLSQLSPPIPPLSCLGQLERACLLAAWQGGVQGQVRSPVTARKKK

SEQ ID NO: 792821 - protein, 101 aa, Homo sapiens
GLPGVVLGRQGPCVCGRGATADTNTDRVRLEDKPYSPPPHLPRTSEALAQFSLRGAGSPTQAEFLPSKRKHRQPSFSYGLWILKTRCGEGREASAPGTPAG

SEQ ID NO: 792822 - protein, 109 aa, Homo sapiens
LPLIVMRDPFQTEELLQLFVRANPNVQTPSGTPSKKKHHFFFQAAIPHRGLFGSVDCKKRAWETISSGSVFLQALMKGISIVRFFKCSLTLKYIKITKYVPQETWENTK

SEQ ID NO: 792823 - protein, 76 aa, Homo sapiens
PCQVEGEPPVSISWQRDRLALANESGVTLMPDGSLHLAALPSRRSLPSRAHEYHCVAQNRYGRLVSRQARVQLASK

SEQ ID NO: 792824 - protein, 123 aa, Homo sapiens
QRPHHYVTKVFWNLVFQRLLERRARPAPSKPQPGRCRHAPTSSSPIYCLLENPGPSSPSPPLPLGAAQGEPGTMRAPNSCKDLSEPLRKRRSHLSFWKPEPQVSPGSLCTCNYLISIKSVFSL

SEQ ID NO: 792825 - protein, 109 aa, Homo sapiens
NPFLIVWVALKRAFGFRTPRNASLGAGVLGDSLGALGHGVLGQLAGQQQANGRLHFAGRDGGALVVVCQAGGLAGDALEDVIDEGVHDAHGLGRDAGVGVHLLQHLVHV

SEQ ID NO: 792826 - protein, 116 aa, Homo sapiens
DRVSLSLPRLECNGAISAHHNLRLPDSSDSPASASREAGITGMCHHARLIFVFLVERGFLHFGQAGLRLPTSGDPPASASQSAGITGVSHWPGQSYEFLKHFILCISVRRHHHALT

SEQ ID NO: 792827 - protein, 147 aa, Homo sapiens
CRLYQSVKLMYSIGIFFTYALQFHVPAEIIIPFAISQVSESWALFVDLSVRSALVCLTCVSAILIPRLDLVISLVGSVSSSALALIIPALLEIVIFYSEDMSCVTIAKDIMISIVGLLGCIFGTYQALYELPQPISHSMANSTGVHA

SEQ ID NO: 792828 - protein, 147 aa, Homo sapiens
RHLHPLVKKRKQTSKNNIEKKKPKFRKRKRKAILKCSFENVYSDDALSKENRVVCETEVLLKELEQMLQQALQPTATPDESEEGHGEEINMGEKLSKCSPEAPAGSLFENHYEEDYLVIDGIKLKAGECIEDITNKFKEIDALMSEF

SEQ ID NO: 792829 - protein, 240 aa, Homo sapiens
WIKATFVGHYSITLKTGVQWHNLASLQHLPPRFKQFSYLSLPSSWELQPEKCKNKKKWYKSALQEACLLYGYSHEQRLEMCCLSKQQDKSETHDKVAALVKKRKQTSKNNIEKKKPKFRKRKRKAILKCSFENVYSDDALSKENRVVCETEVLLKELEQMLQQALQPTATPDESEEGHGEEINMGEKLSKCSPEAPAGSLFENHYEEDYLVIDGIKLKAGECIEDITNKFKEIDALMSEF

SEQ ID NO: 792830 - protein, 148 aa, Homo sapiens
RINTGERRGEEKQTSKNNIEKKKPKFRKRKRKAILKCSFENVYSDDALSKENRVVCETEVLLKELEQMLQQALQPTATPDESEEGHGEEINMGEKLSKCSPEAPAGSLFENHYEEDYLVIDGIKLKAGECIEDITNKFKEIDALMSEF

SEQ ID NO: 792831 - protein, 254 aa, Homo sapiens
WIKATFVGHYSITLKTGVQWHNLASLQHLPPRFKQFSYLSLPSSWELQPEKCKNKKKWYKSALQEACLLYGYSHEQRLEMCCLSKQQDKSETHDKVAALVKKRKQTSKNNIEKKKPKFRKRKRKAILKCSFENVYSDDALSKENRVVCETEVLLKELEQMLQQALQPTATPDESEEGHGEEINMGEKLSKCSPEAPAGSLFENHYEEDYLVIDGIKLKAGECIEDITNKFKEIDADAANPPFPLSILRSNRREP

SEQ ID NO: 792832 - protein, 235 aa, Homo sapiens
WIKATFVGHYSITLKTGVQWHNLASLQHLPPRFKQFSYLSLPSSWELQPEKCKNKKKWYKSALQEACLLYGYSHEQRLEMCCLSKQQDKSETHDKVAALVKKRKQTSKNNIEKKKPKFRKRKRKAILKCSFENVYSDDALSKENRVVCETEVLLKELEQMLQQALQPTATPDESEEGHGEEINMGEKTIFFFGDRVSLCHQGWSEVMQSLLTAISASQVQVILLPQPPEYLGITE

SEQ ID NO: 792833 - protein, 143 aa, Homo sapiens
MWSGPAQNDSQANPPTTFLSHIETPTKPHDSLHPTHWKYLLLGLLLKQLHLHDRRGAPLLSCNLVVPRSREVTILMPNLVRTPDRHSALQPRTPGLKRSSSLSLPSSWDYRHEPLHPALQGISKKGKCKIVCMLYHCLCMIGG

SEQ ID NO: 792834 - protein, 101 aa, Homo sapiens
THGDPAQPIPTLASTQIHSARPQLQALSPQPPPLTCALDLRLSFPSYLSFLPPSILCPPTIHGCQRRPLRSHTWGLIASLASPDPPRSPSCAVISAVLRTV

SEQ ID NO: 792835 - protein, 107 aa, Homo sapiens
ESHSVTQARMQWQDLSSRQPLPPGFKQFLCSWDYIAMHHHAWLIFVFLVGMRFHHFGQAGLKLLTSSDLPASASQNSGIAGVSHCAWLQIVPISAYKSVDKLIPESF

SEQ ID NO: 792836 - protein, 27 aa, Homo sapiens
MESRSLDQAGVQWHNLGSLQPSPPGFK

SEQ ID NO: 792837 - protein, 84 aa, Homo sapiens
LSTQLPLGHGFLASPAGNRELLQSWRREGVTQITSAESRAWPGMGFTEALFHPSMLVPTFTSGSPEVLREPRVLGPQPQPLPST

SEQ ID NO: 792838 - protein, 116 aa, Homo sapiens
WRLCSLRCLVSEQLGWSRPQRFRSHVGKCDLNFKTLSFPGGRVPKFIPTYGSPGGPGLPLPLDASRAGMRDRETLRFRSPRRLPGARAGDIPSVQPSTLSPQFFPTFAFQESSSKT

SEQ ID NO: 792839 - protein, 299 aa, Homo sapiens
MTLSVLSRKDKERVIRRLLLQAPPGEFVNAFDDLCLLIRDEKLMHHQGECAGHQHCQKYSVPLCIDGNPVLLSHHNVMGDYRFFDHQSKLSFKYDLLQNQLKDIQSHGIIQNEAEYLRVVLLCALKLYVNDHYPKGNCNMLRKTVKSKEYLIACIEDHNYETGECWNGLWKSKWIFQVNPFLTQVTGRIFVQAHFFRCVNLHIEISKDLKESLEIVNQAQLALSFARLVEEQENKFQAAVLEELQELSNEALRKILRRDLPVTRTLIDWHRILSDLNLVMYPKLGYVIYSRSVLCNWII

SEQ ID NO: 792840 - protein, 73 aa, Homo sapiens
MCFKFYISWRGQDRLTFRLQSASSRRFCPQPGEVGNRFPQDFHWELRGRPVPGGGAGWSPPGGDRRLAGGRRG

SEQ ID NO: 792841 - protein, 47 aa, Homo sapiens
MGPHLCHFNRETVYQKLDQDLQLFKLHPLVLPQTFKASQNKSNFSMT

SEQ ID NO: 792842 - protein, 117 aa, Homo sapiens
TQNKPRQPRGAADACTTEKSNKSSLHPNRHGHSSSDPVYPCGICTNEVNDDQDAILCEASCQKWFHRICTGMTETAYGLLTAEASAVWGCDTCMADKDVQLMRTRETFGPSAVGSDA

SEQ ID NO: 792843 - protein, 120 aa, Homo sapiens
GDMKKQGNVTPSEETSNSPATDPHPKEIQESSNRELSRELTGLIVKKVINMEESFEQQHKEMRKRGGEIYEMITCQKEVLKFNRRVFLELKKSLDEIQSTLKSFNDRLEQIEEKLSGHKI

SEQ ID NO: 792844 - protein, 103 aa, Homo sapiens
FYHHNHSIITVCPEQRSPRCSLQFLPGSRTGDGRTGDKSGSENGGRGQSLPQNWEAQKWCPCPSMDFLSTVFSPFHAQLPSHQPGAHGGEKLRMCLKSKGSFV

SEQ ID NO: 792845 - protein, 144 aa, Homo sapiens
ARRSGLGEGHTRLGPTSWPSRSAEWPGTWMPWGHGVNCRLRLSGAPAAVSPRTKFRSQHPNRKGPCPRPERPLAHGRGGGAASPRAGAFRPSLAARGSLSLPLPGFCCRAPSLCGPRVNPISRGEAPVTPAFLTPAASPPLHRG

SEQ ID NO: 792846 - protein, 162 aa, Homo sapiens
ATPASSTPEEPAKQDLTALSGKAHFVSKITSSKPSAVASEKFKEQVDLAKTMTNLSPTILGNAVQLISSVPKGKLPIPPYSRMKTMEVYKIKSDANIAGFSLPGPKADCDKIPSTTEGFNAATKVASRLPVPQVSQQSACESAFCPPTKLDLNHKTKLNSGA

SEQ ID NO: 792847 - protein, 1220 aa, Homo sapiens
GSPNVVFLKIKYSEPNVSKKESPPLRERQSLVFKMKKFNFRKVLDGLTASSPGSGSSSGSNSGGGAGSGSVHPAGTAGVLREEIQETLTSEYFQICKTVRHGFPHQPTALAFDPVQKILAIGTRTGAIRILGRPGVDCYCQHESGAAVLQLQFLINEGALVSASSDDTLHLWNLRQKRPAILHSLKFNRERITYCHLPFQSKWLYVGTERGNTHIVNIESFILSGYVIMWNKAIELSTKTHPGPVVHLSDSPRDEGKLLIGYENGTVVFWDLKSKRAELRVYYDEAIHSIDWHHEGKQFMCSHSDGSLTLWNLKSPSRPFQTTIPHGKSQREGRKSESCKPILKVEYKTCKNSEPFIIFSGGLSYDKACRRPSLTIMHGKAITVLEMDHPIVEFLTLCETPYPNEFQEPYAVVVLLEKDLIVVDLTQSNFPIFENPYPMDIHESPVTCTAYFADCPPDLILVLYSIGVKHKKQGYSNKEWPISGGAWNLGAQTYPEIIITGHADGSIKFWDASAITLQMLYKLKTSKVFEKQKVGEGKQTCEIVEEDPFAIQMIYWCPESRIFCVSGVSAYVIIYKFSRHEITTEIVSLEVRLQYDVEDIITPEPETSPPFPDLSAQLPSSRSLSGSTNTVASEGVTKDSIPCLNVKTRPVRMPPGYQAELVIQLVWVDGEPPQQITSLAVSSAYGIVAFGNCNGLAVVDFIQKTVLLSMGTIDLYRSSDLYQRQPRSPRKNKQFIADNFCMRGLSNFYPDLTKRIRTSYQSLTELNDSPVPLELERCKSPTSDHVNGHCTSPTSQSCSSGKRLSSADVSKVNRWGPGRPPFRKAQSAACMEISLPVTTEENRENSYNRSRSSSISSIDKDSKEAITALYFMDSFARKNDSTISPCLFVGTSLGMVLIISLNLPLADEQRFTEPVMVLPSGTFLSLKGAVLTFSCMDRMGGLMQPPYEVWRDPNNIDENEKSWRRKVVMNSSSASQEIGDHQYTIICSEKQAKVFSLPSQTCLYVHNITETSFILQANVVVMCSSACLACFCANGHIMIMSLPSLRPMLDVNYLPLTDMRIARTFCFTNEGQALYLVSPTEIQRLTYSQEMCDNLQDMLGDLFTPIETPEAQNRGFLKGLFGGSGQTFDREELFGEASAGKASRSLAQHIPGPGSIEGMKGAAGGVMGELTRARIALDERGQRLGELEEKTAGMMTSAEAFSKHAHELMLKYKDKKWYQF

SEQ ID NO: 792848 - protein, 1227 aa, Homo sapiens
TSESARRRDQRAQRSGRSPPTSAPSASRAGRRLEASEEVFKMKKFNFRKVLDGLTASSPGSGSSSGSNSGGGAGSGSVHPAGTAGVLREEIQETLTSEYFQICKTVRHGFPHQPTALAFDPVQKILAIGTRTGAIRILGRPGVDCYCQHESGAAVLQLQFLINEGALVSASSDDTLHLWNLRQKRPAILHSLKFNRERITYCHLPFQSKWLYVGTERGNTHIVNIESFILSGYVIMWNKAIELSTKTHPGPVVHLSDSPRDEGKLLIGYENGTVVFWDLKSKRAELRVYYDEAIHSIDWHHEGKQFMCSHSDGSLTLWNLKSPSRPFQTTIPHGKSQREGRKSESCKPILKVEYKTCKNSEPFIIFSGGLSYDKACRRPSLTIMHGKAITVLEMDHPIVEFLTLCETPYPNEFQEPYAVVVLLEKDLIVVDLTQSNFPIFENPYPMDIHESPVTCTAYFADCPPDLILVLYSIGVKHKKQGYSNKEWPISGGAWNLGAQTYPEIIITGHADGSIKFWDASAITLQMLYKLKTSKVFEKQKVGEGKQTCEIVEEDPFAIQMIYWCPESRIFCVSGVSAYVIIYKFSRHEITTEIVSLEVRLQYDVEDIITPEPETSPPFPDLSAQLPSSRSLSGSTNTVASEGVTKDSIPCLNVKTRPVRMPPGYQAELVIQLVWVDGEPPQQITSLAVSSAYGIVAFGNCNGLAVVDFIQKTVLLSMGTIDLYRSSDLYQRQPRSPRKNKQFIADNFCMRGLSNFYPDLTKRIRTSYQSLTELNDSPVPLELERCKSPTSDHVNGHCTSPTSQSCSSGKRLSSADVSKVNRWGPGRPPFRKAQSAACMEISLPVTTEENRENSYNRSRSSSISSIDKDSKEAITALYFMDSFARKNDSTISPCLFVGTSLGMVLIISLNLPLADEQRFTEPVMVLPSGTFLSLKGAVLTFSCMDRMGGLMQPPYEVWRDPNNIDENEKSWRRKVVMNSSSASQEIGDHQYTIICSEKQAKVFSLPSQTCLYVHNITETSFILQANVVVMCSSACLACFCANGHIMIMSLPSLRPMLDVNYLPLTDMRIARTFCFTNEGQALYLVSPTEIQRLTYSQEMCDNLQDMLGDLFTPIETPEAQNRGFLKGLFGGSGQTFDREELFGEASAGKASRSLAQHIPGPGSIEGMKGAAGGVMGELTRARIALDERGQRLGELEEKTAGMMTSAEAFSKHAHELMLKYKDKKWYQF

SEQ ID NO: 792849 - protein, 79 aa, Homo sapiens
MATPRGVVGALWRRMCACMSGKLFLMYASALLSHTVPKRKPCAGWCSCAGDPVSASACPSGPLTIEGRAVLRGGAVLGT

SEQ ID NO: 792850 - protein, 113 aa, Homo sapiens
RRRGFTMLPRWVLELLASSDPPTSAPQSTGITGVGHHTQLDGICILNKAPGDSSLRLSSFFKCCSGCRGAGGASTGIPPALQPCSGTLEATPYYPGGSGAIASCSVTLLGVKL

SEQ ID NO: 792851 - protein, 239 aa, Homo sapiens
PRWLWARPVAFTGFLTHSWSVRVLFFFNWRWQMTVLLDFLYAHLTPAGPEIIGVPRSLWYHAPIVTTRRMTKSMPVVEEDKKEEWSCREEARQDHLQPGAAGLASQGLAPAWARQEAMMNNAIILLFIGGTWAYLKTLKKCLHFQSLRKGRSSSYSGFFMPSSGIEEPALNATWKTAWTCTFGPGHPWELSPCRLNPFWILFSPDCPRVQVFSSLVCPVKVQGWKGEGVESGALFHCWA

SEQ ID NO: 792852 - protein, 229 aa, Homo sapiens
TKTQASKTHGLFQASPGSALAQVRPKTSVCGQGRNRTQGSVSALLCPQKLATDHQPSILGEPVGGLPQDRDGDLARSFSQGFVTYSQENNSESSLQSSSSLSLSTMSVASLPAVNKIDESRESSLEGDLAVKSVFPPESMGTLQRFKDTQETETGYRYMTLHFPYRPTPASEKVPSFQHSSVSNCLTLRVHWGSEAEIHKFSLGKSSVNLIEVSQATVKTELRRTLSLG

SEQ ID NO: 792853 - protein, 563 aa, Homo sapiens
PTSPVTSGLPLFFVITVTAIKQGYEDCLRHRADNEVNKSTVYIIENAKRVRKESEKIKVGDVVEVQADETFPCDLILLSSCTTDGTCYVTTASLDGESNCKTHYAVRDTIALCTAESIDTLRAAIECEQPQPDLYKFVGRINIYSNSLEAVARSLGPENLLLKGATLKNTEKIYGVAVYTGMETKMALNYQGKSQKRSAVEKSINAFLIVYLFILLTKAAVCTTLKYVWQSTPYNDEPWYNQKTQKERETLKVLKMFTDFLSFMVLFNFIIPVSMYVTVEMQKFLGSFFISWDKDFYDEEINEGALVNTSDLNEELGQVDYVFTDKTGTLTENSMEFIECCIDGHKYKGVTQEVDGLSQTDGTLTYFDKVDKNREELFLRALCLCHTVEIKTNDAVDGATESAELTYISSSPDEIALVKGAKRYGFTFLGNRNGYMRVENQRKEIEEYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATA

SEQ ID NO: 792854 - protein, 539 aa, Homo sapiens
PTSPVTSGLPLFFVITVTAIKQGYEDCLRHRADNEVNKSTVYIIENAKRVRKESEKIKVGDVVEVQADETFPCDLILLSSCTTDGTCYVTTASLDGESNCKTHYAVRDTIALCTAESIDTLRAAIECEQPQPDLYKFVGRINIYSNSLEAVARSLGPENLLLKGATLKNTEKIYGVAVYTGMETKMALNYQGKSQKRSAVEKSINAFLIVYLFILLTKAAVCTTLKYVWQSTPYNDEPWYNQKTQKERETLKVLKMFTDFLSFMVLFNFIIPVSMYVTVEMQKFLGSFFISWDKDFYDEEINEGALVNTSDLNEELGQVDYVFTDKTGTLTENSMEFIECCIDGHKYKGVTQEVDGLSQTDGTLTYFDKVDKNREELFLRALCLCHTVEIKTNDAVDGATESAELTYISSSPDEIALVKGAKRYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATA

SEQ ID NO: 792855 - protein, 130 aa, Homo sapiens [sequence omitted]

SEQ ID NO: 792856 - protein, 39 aa, Homo sapiens
MWEMGTMGQKWAEEAPSPRPQFPHLYNEGPFFHGSKSHT

SEQ ID NO: 792857 - protein, 123 aa, Homo sapiens
FSVMFFPSACINRSSSLKKSKVPVNLESLFYCWVRWLTPVDTETNRERQQRQRPGERSLASSPLGSLPVGSMRHPNSSHKNLFTLLKIDEASFYFMKVHRSGLSVVVHACNPSTLGGRGRHIT

SEQ ID NO: 792858 - protein, 109 aa, Homo sapiens
KPATDIEEPIYTMDKQSSAGGVKRSVPCDSNEANEMMPETPTGDSDPQPAPKKMKTSESSTILVVRYRRNFKRTSPEELLNDHARENRINPLQMEEEEFMEIMVEIPAK

SEQ ID NO: 792859 - protein, 153 aa, Homo sapiens
ICGLDPRIQPPKLLLGNHLGQLHPMTTYAPPVIDSPEKMEFKVIGPIGPDIFTRLLRTQLSSPVLRFQLGHNIGGQKTDSQGTNWNSQGECQHTGWLPHHRPESGPGLASSGQPTRGMSWKELWPTQGGPKYTKSQVLLLLSPFYSGKTRHIV

SEQ ID NO: 792860 - protein, 82 aa, Homo sapiens
CCIHNSKDSGPTQMSNNDKVDLRKCGEDGRIGTAPVYSSQRERRRRQLSGTGTQIQIGTLIWPLDKTVNPFCMRRNLCLIFS

SEQ ID NO: 792861 - protein, 124 aa, Homo sapiens
SLALTAFVKVSSFYWSELVTKLDIDPCRGLSFSKSGRRPSAPGKLNEMKIPGPIQNQRIRSPKTRDARCASYQTTGPRAPKTTLGEPDFSYQNILCDFKSGVCLMPPSWSGVGRRIVCWGTSHN

SEQ ID NO: 792862 - protein, 108 aa, Homo sapiens
MQPVQEDGGKEKPEPGLELRRAESCGGPSGLGDAVREHEPRVPEGPERHSAIGSDHQVGDAAIVEGAMEPAFGRKLQRCVLSSAANDTGVTSEDLLIILPLLGIPRGM

SEQ ID NO: 792863 - protein, 74 aa, Homo sapiens
EAFFKSGSHAANDSKSQACSTVYTHSSQYQVRLQFSHAQSYGLESLLIRLVDGRGCLVSDETLDLDFWVNAGMS

SEQ ID NO: 792864 - protein, 126 aa, Homo sapiens
IFSLLISLFAFFLVISNINLQIRSSFLLLVVYISWCPNYVFVPTWVYVTMLLQTKAHICRWNTRMIVKKYRAAFLKELKRRNTSLSCEKESRLPLKDEFTLHIFISTEINIKCFCLFQGPFINFFQ

SEQ ID NO: 792865 - protein, 110 aa, Homo sapiens
RHFIGLMQMIEGMRHEEGECSYELEVESYLQMEDVTSTFIAPRNESNNLASDTFITHKKSSFIKNINQGSSSSVIESDEECAEIVKQTHIKPTKIVSLKKKVSKEIKKDQ

SEQ ID NO: 792866 - protein, 74 aa, Homo sapiens
MQNGQASVVGRMAHGKVSHGPETVRGLLSWSWSGSNSKSSMVERTMSVKDEANDKLRIAIQKSDPISEENNNLN

SEQ ID NO: 792867 - protein, 112 aa, Homo sapiens
LFCFLRHSLTLSPRLECSGTILAHCNLCLLGSSDLSLASTQTTGACHHAQLIFVFFVEMESHHVAQAGRLKLLGSSNLLTLVSQSVEIIGMSHCAWPKGIFIESFYKCHHVV

SEQ ID NO: 792868 - protein, 59 aa, Homo sapiens
PPALFACARATWIPWIEMAGPQNAIHLDPGVPKELPWRPAGPSAEFQKVRNKILCVIPL

SEQ ID NO: 792869 - protein, 560 aa, Homo sapiens
MPRATALGALVSLLLLLPLPRGAGGLGERPDATADYSELDGEEGTEQQLEHYHDPCKAAVFWGDIALDEDDLKLFHIDKARDWTKQTVGATGHSTGGLEEQASESSPDTTAMDTGTKEAGKDGRENTTLLHSPGTLHAAAKTFSPRVRRATTSRTERIWPGGVIPYVIGGNFTGSQRAIFKQAMRHWEKHTCVTFIERTDEESFIVFSYRTCGCCSYVGRRGGGPQAISIGKNCDKFGIVAHELGHVVGFWHEHTRPDRDQHVTIIRENIQPGQEYNFLKMEAGEVSSLGETYDFDSIMHYARNTFSRGVFLDTILPRQDDNGVRPTIGQRVRLSQGDIAQARKLYKCPACGETLQDTTGNFSAPGFPNGYPSYSHCVWRISVTPGEKIVLNFTSMDLFKSRLCWYDYVEVRDGYWRKAPLLGRFCGDKIPEPLVSTDSRLWVEFRSSSNILGKGFFAAYEATCGGDMNKDAGQIQSPNYPDDYRPSKECVWRITVSEGFHVGLTFQAFEIERHDSCAYDYLEVRDGPTEESALIGHFCGYEKPEDVKSSSNRLWMKFVS

SEQ ID NO: 792870 - protein, 1015 aa, Homo sapiens
MPRATALGALVSLLLLLPLPRGAGGLGERPDATADYSELDGEEGTEQQLEHYHDPCKAAVFWGDIALDEDDLKLFHIDKARDWTKQTVGATGHSTGGLEEQASESSPDTTAMDTGTKEAGKDGRENTTLLHSPGTLHAAAKTFSPRVRRATTSRTERIWPGGVIPYVIGGNFTGSQRAIFKQAMRHWEKHTCVTFIERTDEESFIVFSYRTCGCCSYVGRRGGGPQAISIGKNCDKFGIVAHELGHVVGFWHEHTRPDRDQHVTIIRENIQPGQEYNFLKMEAGEVSSLGETYDFDSIMHYARNTFSRGVFLDTILPRQDDNGVRPTIGQRVRLSQGDIAQARKLYKCPACGETLQDTTGNFSAPGFPNGYPSYSHCVWRISVTPGEKIVLNFTSMDLFKSRLCWYDYVEVRDGYWRKAPLLGRFCGDKIPEPLVSTDSRLWVEFRSSSNILGKGFFAAYEATCGGDMNKDAGQIQSPNYPDDYRPSKECVWRITVSEGFHVGLTFQAFEIERHDSCAYDYLEVRDGPTEESALIGHFCGYEKPEDVKSSSNRLWMKFVSDGSINKAGFAANFFKEVDECSWPDHGGCEHRCVNTLGSYKCACDPGYELAADKKMCEVACGGFITKLNGTITSPGWPKEYPTNKNCVWQVVAPAQYRISLQFEVFELEGNDVCKYDFVEVRSGLSPDAKLHGRFCGSETPEVITSQSNNMRVEFKSDNTVSKRGFRAHFFSDKDECAKDNGGCQHECVNTFGSYLCRCRNGYWLHENGHDCKEAGCAHKISSVEGTLASPNWPDKYPSRRECTWNISSTAGHRVKLTFNEFEIEQHQECAYDHLEMYDGPDSLAPILGRFCGSKKPDPTVASGSSMFLRFYSDASVQRKGFQAVHSTECGGRLKAEVQTKELYSHAQFGDNNYPSEARCDWVIVAEDGYGVELTFRTFEVEEEADCGYDYMEAYDGYDSSAPRLGRFCGSGPLEEIYSAGDSLMIRFRTDDTINKKGFHARYTSTKFQDALHMKK

SEQ ID NO: 792871 - protein, 251 aa, Homo sapiens
MSSSIITATHPLHSQLDVSLHSSPLPVPELERRPPPQLNARPLPYFLLFCPQTFNEFEIEQHQECAYDHLEMYDGPDSLAPILGRFCGSKKPDPTVASGSSMFLRFYSDASVQRKGFQAVHSTECGGRLKAEVQTKELYSHAQFGDNNYPSEARCDWVIVAEDGYGVELTFRTFEVEEEADCGYDYMEAYDGYDSSAPRLGRFCGSGPLEEIYSAGDSLMIRFRTDDTINKKGFHARYTSTKFQDALHMKK

SEQ ID NO: 792872 - protein, 538 aa, Homo sapiens
MPRATALGALVSLLLLLPLPRGAGGLGERPDATADYSELDGEEGTEQQLEHYHDPCKAAVFWGDIALDEDDLKLFHIDKARDWTKQTVGATGHSTGGLEEQASESSPDTTAMDTGTKEAGKGSQRAIFKQAMRHWEKHTCVTFIERTDEESFIVFSYRTCGCCSYVGRRGGGPQAISIGKNCDKFGIVAHELGHVVGFWHEHTRPDRDQHVTIIRENIQPGQEYNFLKMEAGEVSSLGETYDFDSIMHYARNTFSRGVFLDTILPRQDDNGVRPTIGQRVRLSQGDIAQARKLYKCPGPTCAFVSQKTSICLLHFSPTCSEGFGWQRACGETLQDTTGNFSAPGFPNGYPSYSHCVWRISVTPGEKIVLNFTSMDLFKSRLCWYDYVEVRDGYWRKAPLLGRFCGDKIPEPLVSTDSRLWVEFRSSSNILGKGFFAAYEATCGGDMNKDAGQIQSPNYPDDYRPSKECVWRITVSEGFHVGLTFQAFEIERHDSCAYDYLEVRDGPTEESALIGHFCGYEKPEDVKSSSNRLWMKFVS

SEQ ID NO: 792873 - protein, 460 aa, Homo sapiens
MKFVSDGSINKAGFAANFFKEVDECSWPDHGGCEHRCVNTLGSYKCACDPGYELAADKKMCEVACGGFITKLNGTITSPGWPKEYPTNKNCVWQVVAPAQYRISLQFEVFELEGNDVCKYDFVEVRSGLSPDAKLHGRFCGSETPEVITSQSNNMRVEFKSDNTVSKRGFRAHFFSDKDECAKDNGGCQHECVNTFGSYLCRCRNGYWLHENGHDCKEAGCAHKISSVEGTLASPNWPDKYPSRRECTWNISSTAGHRVKLTFNEFEIEQHQECAYDHLEMYDGPDSLAPILGRFCGSKKPDPTVASGSSMFLRFYSDASVQRKGFQAVHSTECGGRLKAEVQTKELYSHAQFGDNNYPSEARCDWVIVAEDGYGVELTFRTFEVEEEADCGYDYMEAYDGYDSSAPRLGRFCGSGPLEEIYSAGDSLMIRFRTDDTINKKGFHARYTSTKFQDALHMKK

SEQ ID NO: 792874 - protein, 98 aa, Homo sapiens
GLQPYTEWLQLHPGGQGSCLLLSCFNGIGGPGPQLGFGWLQRHPGSSRLNLEGQGSHQLHGACSPSWLRCCSRRNGRGRPSGAATAIKINSFPTCSNN

SEQ ID NO: 792875 - protein, 147 aa, Homo sapiens
MQRAVEGASMESPSTIEDQETVAGGREAWAGPAPRAAEHRTAAPKDAPGQASAPPTGGSPAPGEPAAPSILVDGGGELRLGLSTVVPVPCGPADADASSRGCSLGRMESPVGASRGQVSRPHGVWFLGGPKFPQSFRQNGGRRLLLL

SEQ ID NO: 792876 - protein, 305 aa, Homo sapiens
MSVDPACPQSLPCFEASDCKESSPMPVICGPEENYPSLQMSSAEMPHTETVSPLPSSMDLLIQDSPDSSTSPKGKQPTSAEKSVAKKEDKVPVKKQKTRTVFSSTQLCVLNDRFQRQKYLSLQQMQELSNILNLSYKQVKTWFQNQRMKSKRWQKNNWPKNSNGVTQKASAPTYPSLYSSYHQGCLVNPTGNLPMWSNQTWNNSTWSNQTQNIQSWSNHSWNTQTWCTQSWNNQAWNSPFYNCGEESLQSCMQFQPNSPASDLEAALEAAGEGLNVIQQTTRYFSTPQTMDLFLNYSMNMQPEDV

SEQ ID NO: 792877 - protein, 448 aa, Homo sapiens
KQKEITSHRRVMSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPGSLRCPVCLSMEGCLEGTTEEICPKGTTHCYDGLLRLRGGGIFSNLRVQGCMPQPGCNLLNGTQEIGPVGMTENCNRKDFLTCHRGTTIMTHGNLAQEPTDWTTSNTEMCEVGQVCQETLLLIDVGLTSTLVGTKGCSTVGAQNSQKTTIHSAPPGVLVASYTHFCSSDLCNSASSSSVLLNSLPPQAAPVPGDRQCPTCVQPLGTCSSGSPRMTCPRGATHCYDGYIHLSGGGLSTKMSIQGCVAQPSSFLLNHTRQIGIFSAREKRDVQPPASQHEGGGAEGLESLTWGVGLALAPALWWGVVCPSC

SEQ ID NO: 792878 - protein, 148 aa, Homo sapiens
AGDAERQLMFQFEGHRAGRVVHVDRVPRPFAENPLLLGGGSAFSFCLGPQLLDKACPQEGEGSTFLIKMLMPSQKHPEQFFFFFEMEPCSVSQDGVQWRNLGSPQPPPPGLTRFSYLSPLSSWDYRRVPAHPPNFCIFSRDRVSPCWP

SEQ ID NO: 792879 - protein, 99 aa, Homo sapiens
LPLPEGCVLSTADTSSSLLCGPPLCNAILSLVLRVSARHGLLSTSFLPSTLSCCRVPASFFPNIGCGTEVAMAGVLRMCSKQLCLGLNSPIWLPVLIST

SEQ ID NO: 792880 - protein, 112 aa, Homo sapiens
MSNDRRWAILSGNFQTPPPGRKECLVTSLRGERCLSSPLPVCPGRDVHTLRYREDSSGEKPQASLSAQGIGGPQPAPSSEQHTAFKGLYCCSYPAEALHQASPCKSVSPQRR

SEQ ID NO: 792881 - protein, 126 aa, Homo sapiens
MPSSTLTCKPFDLKQRSSRRGPKSTASASPRSCLKPSCGKQVCLLLSVRRSQSLAHPGRDSTRVLSYQQTSSDAVSQYKHTGKVEELYGLRLSWLSQAQFLLAQDKTAYAVKSVVLPASNHKTKGQ

SEQ ID NO: 792882 - protein, 83 aa, Homo sapiens
TTWAPSHPTLLANVEEEAAPRTHLWVALAWVAQGQTAEAWGAHAQTAEAWGAHAQTAEALQFYGFYVLSWGFDTNTMNFPMFH

SEQ ID NO: 792883 - protein, 33 aa, Homo sapiens
DARMAVLKVGMLQVKTSRPPMPLQGPQSILLVN

SEQ ID NO: 792884 - protein, 55 aa, Homo sapiens
EHWLQTLPIVLIRGLPLDSVGRAQGYCSAPLQDNNTALNVNSDHAEKASPAGTSS

SEQ ID NO: 792885 - protein, 107 aa, Homo sapiens
PEGEAPPTGPGGTRDHIQLTLGPRPPSHGGGWDHAHLAIRGLTLRCHRPLPSFAGRKSRQVRKWRAGPEKPRIRPPFKESHVETHLCYSKLLGCSQPWDFAPSALHG

SEQ ID NO: 792886 - protein, 105 aa, Homo sapiens
HGFACWEYFHFIDEEIEVHIKLFAQGHFLRKWWFWTSPLSSRPHCFPWGNQLFPYHAFLAPQKSTSLGFLCDWLRQQLVRHLGCAGALGDQMVDVACPRCIQSLP

SEQ ID NO: 792887 - protein, 118 aa, Homo sapiens
WGMQEETRVAKQSLAWQGLKETLAMLSSSFSHLSVSVPSLLHQVFPYCFPLYTLKAKMHTMELPPAGIFLLLWSLPYHAPDSICHPHPYPPVLSTFSKKTSTFGHAQREGCCPHMPVS

SEQ ID NO: 792888 - protein, 106 aa, Homo sapiens
DLRGFLLQQSGQGKEKTVLLLESLPTRGFPPVPSRCVDRAGKPSPGPGFVFPKPRDPSRASDPSSQLLFSLPRVLPNAIRSHAGYRTTGHFPVSSKSSPAKFQQFI

SEQ ID NO: 792889 - protein, 100 aa, Homo sapiens
KESFLHIPGNTSHFHMRFLCLDCSFLRYLHVWLLLHVIAQMSLFSEAFPITVSKIAAYPFHTHRLTHEHACRHAHTHTPYTSLSPFPALLFSLHLPYSTM

SEQ ID NO: 792890 - protein, 110 aa, Homo sapiens
LGGTRGRRCAGHREGPRREAASLLCARRRRRAPPAQSPLPTLPPRPPPPTNRTGSSVIRVTSAEMPSLTTQVEGTANLFSWTLFFISFTVFLPSKIILSASTYIAFPLET

SEQ ID NO: 792891 - protein, 82 aa, Homo sapiens [sequence omitted]

SEQ ID NO: 792892 - protein, 69 aa, Homo sapiens
AENWVLSPTAQKEVKPANSHRMSLEVYLVPVEPCVDCSPTGVIFNAAIDKEYTRMELPHGQEEETHKER

SEQ ID NO: 792893 - protein, 150 aa, Homo sapiens
EHLLCARHWSLGGPPAVSRLWNSQAGNIFQKVFQEEVTEMGVTPSRTRRNQVGRHGSRAKDNPGHHGHELPLHSTALHSRLGDRTRPRLKQTNKKNTTLRNYFTPFKMAGMATIKKTDNNKYWQGHGETGVLSRNDGGNIKWYSCFRKQV

SEQ ID NO: 792894 - protein, 123 aa, Homo sapiens
RVLGAGRVLPDSLSLSPPPPTGCQTKPERGWGAQPPPPQGARVSVLVPRRHPCDIRTSSSVTCVCVCAQVSERFRTPTPSTLKSEQNKKLGSSSPPNLSPASLPSVLPASSRPRQILKSRRQN

SEQ ID NO: 792895 - protein, 116 aa, Homo sapiens
RVLGAGRVLPDSLSLSPPPPTGCQTKPERGWGAQPPSVLVPRRHPCDIRTSSSVTCVCVCAQVSERFRTPTPSTLKSEQNKKLGSSSPPNLSPASLPSVLPASSRPRQILKSRRQN

SEQ ID NO: 792896 - protein, 148 aa, Homo sapiens
MYPIRSLALYSYKLNFHYCRLTSEWTHLTIPCIVPGTLRAFTTFCIIFTSVFDVLKNTVHNYFTASPSTWRPAGFPSPSLPNHVGTETRGTAGLLPIVTKQWTPLLLRFPNRGWDTQPREYEENNLRVFEPLASFCGPITFSLLILHK

SEQ ID NO: 792897 - protein, 78 aa, Homo sapiens
ENKSTLQLEQQVKELKKSGGAEEPRGSESAAAARPVAGAPVPQGAWMCGQAGWTPQEHPGLSGEAVGTGEAAGGAGEA

SEQ ID NO: 792898 - protein, 174 aa, Homo sapiens
AVWEPLIERVEGKRQWNLRLDVKKNPVQDKSLLPGDDFIPEPQMAIHISSGNTMNITISKSCLNVFNNLAKGFSEGTASTFDYSLKDRAPFTVKNAVGVPIKVKPNCNLRVMGFPEKSDIFDVDAGQNLELEYASMVPSSQGNLSILSRQESSFFTLTIVPHGYTEVANIPVAR

SEQ ID NO: 792899 - protein, 66 aa, Homo sapiens
GHAGATFCPAPLPGLCLCLECPPLSAIKVLPTLQVLVHVVASTPRKCSQAFSGLLTKDLASPDLMG

SEQ ID NO: 792900 - protein, 106 aa, Homo sapiens
MKRRFRFLPFPLLSPSLSPGQKDGSLIIRSDYYCGFEFEVGFSSTPDSWKIRSPVSSRPLLASLSAPRLISQAGARSASRRTPGRASGSRRRSPRARPPCSGLRGR

SEQ ID NO: 792901 - protein, 125 aa, Homo sapiens
KDTQILVSRTLANNLCDSVWWIKHLEHLLIWFSSLSHATLPVGQWDPLCSKPRQVFRHLEHKLTWVSSPSCSILPVQRSSYRGTLSAPCPDRSPGIQNTCLPGSAVRVTLPLLCRDLGSGGAHYT

SEQ ID NO: 792902 - protein, 104 aa, Homo sapiens
WGRPPGKALAGLEVGRQGQTGLRVATVIEGGLSKQALGEGWVRIAILQRRVGGNSKQGFRGLQRLLGANFYCFLLKSGWAFREVPGRNSPPICLGGWSGRAKTC

SEQ ID NO: 792903 - protein, 113 aa, Homo sapiens [sequence omitted]

SEQ ID NO: 792904 - protein, 454 aa, Homo sapiens
MELATRYQIPKEVADIFNAPSDDEEFVGFRDDVPMETLSSEESCDSFDSLESGKQQDVRFHSKYFTEELRRIFIEDTDSETEDFAGFTQSDLNGKTNPEVMVVESDLSDDGKASLVSEEEEDEEEDKATPRRSRSRRSSIGLRVAFQFPTKKLANKPDKNSSSEQLFSSARLQNEKKTILERKKDCRQVIQREDSTSESEDDSRDESQESSDALLKRTMNIKENKAMLAQLLAELNSMPDFFPVRTPTSASRKKTVRRAFSEGQITRRMNPTRSARPPEKFALENFTVSAAKFAEEFYSFRRRKTIGGKCREYRRRHRISSFRPVEDITEEDLENVAITVRDKIYDKVLGNTCHQCRQKTIDTKTVCRNQGCCGVRGQFCGPCLRNRYGEDVRSALLDPDWVCPPCRGICNCSYCRKRDGRCATGILIHLAKFYGYDNVKEYLESLQKELVEDN

SEQ ID NO: 792905 - protein, 202 aa, Homo sapiens
MELATRYQIPKEVADIFNAPSDDEEFVGFRDDVPMETLSSEESCDSFDSLESGKQQDVRFHSKYFTEELRRIFIEDTDSETEDFAGFTQSDLNGKTNPEVMVVESDLSDDGKASLVSEEEEDEEEDKATPRRSRSRRSSIGLRVAFQFPTKKLANKPDKNSSSEQLFSSARLQNEKKTILERKKDCRQVVPRGKSPPEFGLT

SEQ ID NO: 792906 - protein, 408 aa, Homo sapiens
MELATRYQIPKEVADIFNAPSDDEEFVGFRDDVPMETLSSEESCDSFDSLESGKQVVESDLSDDGKASLVSEEEEDEEEDKATPRRSRSRRSSIGLRVAFQFPTKKLANKPDKNSSSEQLFSSARLQNEKKTILERKKDCRQVIQREDSTSESEDDSRDESQESSDALLKRTMNIKENKAMLAQLLAELNSMPDFFPVRTPTSASRKKTVRRAFSEGQITRRMNPTRSARPPEKFALENFTVSAAKFAEEFYSFRRRKTIGGKCREYRRRHRISSFRPVEDITEEDLENVAITVRDKIYDKVLGNTCHQCRQKTIDTKTVCRNQGCCGVRGQFCGPCLRNRYGEDVRSALLDPDWVCPPCRGICNCSYCRKRDGRCATGILIHLAKFYGYDNVKEYLESLQKELVEDN

SEQ ID NO: 792907 - protein, 34 aa, Homo sapiens
MQGRDTQLRLGSRLQPQHDPRSKDACPPRSSMYR

SEQ ID NO: 792908 - protein, 78 aa, Homo sapiens
IFQLYKYYVFFLLRFHISKNPKNTQAKETPSKAHYVLALVSQCLHPTNQRAKPGRMTQQSCSTTDCWKNQSLQIGNAE

SEQ ID NO: 792909 - protein, 72 aa, Homo sapiens
TGPPSVDPASLERPSLHRPYIRRTRGTSHPYYLNPHPHLTGPDPPALTQNPPFPQHILQRSAQVGLAEDSKV

SEQ ID NO: 792910 - protein, 386 aa, Homo sapiens
MSALEKSMHLGRLPSRPPLPGSGGSQSGAKMRMGPGRKRDFSPVPWSQYFESMEDVEVENETGKDTFRVYKSGSEGPVLLLLHGGGHSALSWAVFTAAIISRVQCRIVALDLRSHGETKVKNPEDLSAETMAKDVGNVVEAMYGDLPPPIMLIGHSMGGAIAVHTASSNLVPSLLGLCMIDVVEGTAMDALNSMQNFLRGRPKTFKSLENAIEWSVKSGQIRNLESARVSMVGQVKQCEGITSPEGSKSIVEGIIEEEEEDEEGSESISKRKKEDDMETKKDHPYTWRIELAKTEKYWDGWFRGLSNLFLSCPIPKLLLLAGVDRLDKDLTIGQMQGKFQMQVLPQCGHAVHEDAPDKVAEAVATFLIRHRFAEPIGGFQCVFPGC

SEQ ID NO: 792911 - protein, 101 aa, Homo sapiens
VSEELTGKRRDPILVLVLGTYTLWVLRKGWSYNDSKLFSHWSYNNSKLFSQRQKHDFKMTSLVRFSGVWKDLIILPLLKPETYNLKPEIYHKELGKLCQIP

SEQ ID NO: 792912 - protein, 122 aa, Homo sapiens
SGSWAAGESAAPGAETGKKPTVRAKGGLRRLLRPPSPPLRQVSLLPESPGATPPVLSLAPPFLKCYVGAFGDGLRASVSLAQWEVEPKPRSPGLWPCASLAKERPVGRKQGPRRNRENTPGL

SEQ ID NO: 792913 - protein, 34 aa, Homo sapiens
VTSCCFIHCPHSSTTTKQEQDDISSSSETRKIAM

SEQ ID NO: 792914 - protein, 192 aa, Homo sapiens
MACGATLKRPMEFEAALLSPGSPKRRRCAPLPGPTPGLRPPDAEPPPPFQTQTPPQSLQQPAPPGSERRLPTPEQIFQNIKQEYSRYQRWRHLEVVLNQSEACASESQPHSSALTAPSSPGSSWMKKDQPTFTLRQVGIICERLLKDYEDKIREEYEQILNTKLAEQYESFVKFTHDQIMRRYGTRPTSYVS

SEQ ID NO: 792915 - protein, 192 aa, Homo sapiens; identical to SEQ ID NO: 792914

SEQ ID NO: 792916 - protein, 192 aa, Homo sapiens; identical to SEQ ID NO: 792914

SEQ ID NO: 792917 - protein, 192 aa, Homo sapiens; identical to SEQ ID NO: 792914

SEQ ID NO: 792918 - protein, 192 aa, Homo sapiens; identical to SEQ ID NO: 792914

SEQ ID NO: 792919 - protein, 192 aa, Homo sapiens; identical to SEQ ID NO: 792914

SEQ ID NO: 792920 - protein, 147 aa, Homo sapiens
MACGATLKRPMEFEAALLSPGSPKRRRCAPLPGPTPGLRPPDAEPPPPFQTQTPPQSLQQPAPPGSERRLPTPEQIFQNIKQEYSRYQRWRHLEVVLNQSEACASESQPHSSALTAPSSPEQYESFVKFTHDQIMRRYGTRPTSYVS

SEQ ID NO: 792921 - protein, 114 aa, Homo sapiens
MAVGKNKRLTKGGKKGAKKKVVDPFSKKDGYDVKAPAMFNIRNIGKTLVTRTQGTKIASDGLKGRVFEVSLADLQNDEVAFRKFKLITEDVQGKNCLTNFHAFLQVHFIQLERP

SEQ ID NO: 792922 - protein, 192 aa, Homo sapiens; identical to SEQ ID NO: 792914

SEQ ID NO: 792923 - protein, 51 aa, Homo sapiens
KAGGLVHEQEKQDEWGRRVEGEGTSRQAKLLNSNSSKSQGKLWHKHTKHIL

SEQ ID NO: 792924 - protein, 30 aa, Homo sapiens
MSTSSYPKLSRSVCFWRNHSAALKLVRRWD

SEQ ID NO: 792925 - protein, 67 aa, Homo sapiens
KHISQFQESGGQDLGLQQQHKPTNLSNLGSAGDGTDTSVPWSQHSPTFIHLRVIRDLDNLQGPGVLP

SEQ ID NO: 792926 - protein, 113 aa, Homo sapiens
WGVSFVDKVQSCGWLTLVIQSLASSETKPILCGLGPQEKKKVPLSDKIFQELRGYLLGTSQRPTVSLEYPEFGHPGLLSRKRARDTPVPSSNFTCLINPIFLSWGVVRKGRER

SEQ ID NO: 792927 - protein, 546 aa, Homo sapiens
AEEEHGNMSSAEIIGSTNLIILLEDEVFADFFNTFLSLPVFGQTPFYTVENSQWSLWPEIPCNLIAKYKGLLTWLEKCRLPFFCKTNLCFHYILCQEFISFIKSPEGAKMMRWKKADQWLLQKCIGGVRGMWRFYSYLTGSAGEELVDFWILAENILSIDEMDLEVRDYYLSLLLMLRATHLQEGSRVVTLCNMNIKSLLNLSIWHPNQSTTRREILSHMQKVALFKLQSYWLPNFYTHTKMTMAKEEACHGLMQEYETRLYSVCYTHIGGLPLNMSIKKCHHFQKRYSSRKAKRKMWQLVDPDSWSLEMDLKPDAIGMPLQETCPQEKVVIQMPSLKMASSKETRISSLEKDMHYAKISSMENKAKSHLHMEAPFETKVSTHLRTVIPIVNHSSKMTIQKAIKQSFSLGYIHLALCADACAGNPFRDHLKKLNLKVEIQLLDLWQDLQHFLSVLLNNKKNGNAIFRHLLGDRICELYLNEQIGPCLPLKSQTIQGLKELLPSGDVIPWIPKAQKEICKMLSPWYDEFLDEEDYWFLLFTVGRTLG

SEQ ID NO: 792928 - protein, 161 aa, Homo sapiens
AEEEHGNMSSAEIIGSTNLIILLEDEVFADFFNTFLSLPVFGQTPFYTVENSQWSLWPEIPCNLIAKYKGLLTWLEKCRLPFFCKTNLCFHYILCQEFISFIKSPEGEARVSLLKSNWWWCWRDSQEDDEIGSTRNLFPHLDNNCTGRICMICSVPGMMSF

SEQ ID NO: 792929 - protein, 102 aa, Homo sapiens
MMRWKKADQWLLQKCIGGVRGMWRFYSYLTGSAGEELVDFWILAENILSIDEMDLEVRDYYLSLLLMLRATHLQEGSRVVTLCNMNISKNYKASFWGDATKK

SEQ ID NO: 792930 - protein, 176 aa, Homo sapiens
AEEEHGNMSSAEIIGSTNLIILLEDEVFADFFNTFLSLPVFGQTPFYTVENSQWSLWPEIPCNLIAKYKGLLTWLEKCRLPFFCKTNLCFHYILCQEFISFIKSPEGGEELVDFWILAENILSIDEMDLEVRDYYLSLLLMLRATHLQEGSRVVTLCNMNISKNYKASFWGDATKK

SEQ ID NO: 792931 - protein, 76 aa, Homo sapiens
ECGLCPGEYLGTAMVWGQEAFGVSLPRHSLEDPGRHRRVRPCPCQASGIPQHPSEQNLFGKRLLEGLHDYLYRFPK

SEQ ID NO: 792932 - protein, 134 aa, Homo sapiens
SPHRPRVSQKHTLMILTVPQPRPHSCSPGQQELGSITADYSPPTAQTHSRRLTKGAPKSWERSKAETRGQSARLPSQVRTRRLRASPGSRRHGPRASSIAPHQPQEQSGPSWPLRVLKALPSNRPGCLPLPPTL

SEQ ID NO: 792933 - protein, 425 aa, Homo sapiens
AAGPAPPPTRSLSPPLRPAVPPSRRRLFLGEALFQRAGSMAAVETRVCETDGCSSEAKLQCPTCIKLGIQGSYFCSQECFKGSWATHKLLHKKAKDEKAKREVSSWTVEGDINTDPWAGYRYTGKLRPHYPLMPTRPVPSYIQRPDYADHPLGMSESEQALKGTSQIKLLSSEDIEGMRLVCRLAREVLDVAAGMIKPGVTTEEIDHAVHLACIARNCYPSPLNYYNFPKSCCTSVNEVICHGIPDRRPLQEGDIVNVDITLYRNGYHGDLNETFFVGEVDDGARKLVQTTYECLMQAIDAVKPGVRYRELGNIIQKHAQANGFSVVRSYCGHGIHKLFHTAPNVPHYAKNKAVGVMKSGHVFTIEPMICEGGWQDETWPDGWTAVTRDGKRSAQFEHTLLVTDTGCEILTRRLDSARPHFMSQF

SEQ ID NO: 792934 - protein, 293 aa, Homo sapiens
MPTRPVPSYIQRPDYADHPLGMSESEQALKGTSQIKLLSSEDIEGMRLVCRLAREVLDVAAGMIKPGVTTEEIDHAVHLACIARNCYPSPLNYYNFPKSCCTSVNEVICHGIPDRRPLQEGDIVNVDITLYRNGYHGDLNETFFVGEVDDGARKLVQTTYECLMQAIDAVKPGVRYRELGNIIQKHAQANGFSVVRSYCGHGIHKLFHTAPNVPHYAKNKAVGVMKSGHVFTIEPMICEGGWQDETWPDGWTAVTRDGKRSAQFEHTLLVTDTGCEILTRRLDSARPHFMSQF

SEQ ID NO: 792935 - protein, 363 aa, Homo sapiens
SVRWHPWTLVKISSQECFKGSWATHKLLHKKAKDEKAKREVSSWTVEGDINTDPWAGYRYTGKLRPHYPLMPTRPVPSYIQRPDYADHPLGMSESEQALKGTSQIKLLSSEDIEGMRLVCRLAREVLDVAAGMIKPGVTTEEIDHAVHLACIARNCYPSPLNYYNFPKSCCTSVNEVICHGIPDRRPLQEGDIVNVDITLYRNGYHGDLNETFFVGEVDDGARKLVQTTYECLMQAIDAVKPGVRYRELGNIIQKHAQANGFSVVRSYCGHGIHKLFHTAPNVPHYAKNKAVGVMKSGHVFTIEPMICEGGWQDETWPDGWTAVTRDGKRSAQFEHTLLVTDTGCEILTRRLDSARPHFMSQF

SEQ ID NO: 792936 - protein, 293 aa, Homo sapiens; identical to SEQ ID NO: 792934

SEQ ID NO: 792937 - protein, 425 aa, Homo sapiens; identical to SEQ ID NO: 792933

SEQ ID NO: 792938 - protein, 425 aa, Homo sapiens; identical to SEQ ID NO: 792933

SEQ ID NO: 792939 - protein, 272 aa, Homo sapiens
MSESEQALKGTSQIKLLSSEDIEGMRLVCRLAREVLDVAAGMIKPGVTTEEIDHAVHLACIARNCYPSPLNYYNFPKSCCTSVNEVICHGIPDRRPLQEGDIVNVDITLYRNGYHGDLNETFFVGEVDDGARKLVQTTYECLMQAIDAVKPGVRYRELGNIIQKHAQANGFSVVRSYCGHGIHKLFHTAPNVPHYAKNKAVGVMKSGHVFTIEPMICEGGWQDETWPDGWTAVTRDGKRSAQFEHTLLVTDTGCEILTRRLDSARPHFMSQF

SEQ ID NO: 792940 - protein, 406 aa, Homo sapiens
AAGPAPPPTRSLSPPLRPAVPPSRRRLFLGEALFQRAGSMAAVETRVCETDGCSSEAKLQCPTCIKLGIQGSYFCSQECFKGSWATHKLLHKKAKDEKAKREVSSWTVEGDINTDPWAGYRYTGKLRPHYPLMPTRPVPSYIQRPDYADHPLGMSESEQALKGTSQIKLLSSEDIEGMRLVCRLAREVLDVAAGMIKPGVTTEEIDHAVHLSCCTSVNEVICHGIPDRRPLQEGDIVNVDITLYRNGYHGDLNETFFVGEVDDGARKLVQTTYECLMQAIDAVKPGVRYRELGNIIQKHAQANGFSVVRSYCGHGIHKLFHTAPNVPHYAKNKAVGVMKSGHVFTIEPMICEGGWQDETWPDGWTAVTRDGKRSAQFEHTLLVTDTGCEILTRRLDSARPHFMSQF

SEQ ID NO: 792941 - protein, 425 aa, Homo sapiens; identical to SEQ ID NO: 792933

SEQ ID NO: 792942 - protein, 231 aa, Homo sapiens
YQVVLEENGEKNQVQLGKLEATIKSLSAELLKANEIIKKLQGDLKTLMGKLKLKNTVTIQQEKLLAEKEEKLQKEQKELQDVGQSLRIKEQEVCKLQEQLEATVKKLEESKQLLKNNEKLITWLNKELNENQLVRKQDVLGPSTTPPAHSSSNTIRSGISPNLNVVDGRLTYPTCGIGYPVSSAFAFQNTFPHSISAKNTSHPGSGTKVQFQFAVYKTNASLGDCSVTEQL

SEQ ID NO: 792943 - protein, 112 aa, Homo sapiens
EKYGKVIPASAVIFGMAVECAEIRRHHRVGIKDIAGIHLPTNVKFQSPAYSSVDTEETIEPYTTEKMSRVPGGYLALTECFEIMTVDFNNLQELKSLATKKPDKIGIPCLIF

SEQ ID NO: 792944 - protein, 1539 aa, Homo sapiens
MDSYFKAAVSDLDKLLDDFEQNPDEQDYLQDVQNAYDSNHCSVSSELASSQRTSLLPKDQECVNSCASSETSYGTNESSLNEKTLKGLTSIQNEKNVTGLDLLSSVDGGTSDEIQPLYMGRCSKPICDLISDMGNLVHATNSEEDIKKLLPDDFKSNADSLIGLDLSSVSDTPCVSSTDHDSDTVREQQNDTSSELQNREIGGIKELGIKVDTTLSDSYNYSGTENLKDKKIFNQLESIVDFNMSSALTRQSSKMFHAKDKLQHKSQPCGLLKDVGLVKEEVDVAVITAAECLKEEGKTSALTCSLPKNEDLCLNDSNSRDENFKLPDFSFQEDKTVIKQSAQEDSKSLDLKDNDVIQDSSSALHVSSKDVPSSLSCLPASGSMCGSLIESKARGDFLPQHEHKDNIQDAVTIHEEIQNSVVLGGEPFKENDLLKQEKCKSILLQSLIEGMEDRKIDPDQTVIRAESLDGGDTSSTVVESQEGLSGTHVPESSDCCEGFINTFSSNDMDGQDLDYFNIDEGAKSGPLISDAELDAFLTEQYLQTTNIKSFEENVNDSKSQMNQIDMKGLDDGNINNIYFNAEAGAIGESHGINIICETVDKQNTIENGLSLGEKSTIPVQQGLPTSKSEITNQLSVSDINSQSVGGARPKQLFSLPSRTRSSKDLNKPDVPDTIESEPSTADTVVPITCAIDSTADPQVSFNSNYIDIESNSEGGSSFVTANEDSVPENTCKEGLVLGQKQPTWVPDSEAPNCMNCQVKFTFTKRRHHCRACGKVFCGVCCNRKCKLQYLEKEARVCVVCYETISKAQAFERMMSPTGSNLKSNHSDECTTVQPPQENQTSSIPSPATLPVSALKQPGVEGLCSKEQKRVWFADGILPNGEVADTTKLSSGSKRCSEDFSPLSPDVPMTVNTVDHSHSTTVEKPNNETGDITRNEIIQSPISQVPSVEKLSMNTGNEGLPTSGSFTLDDDVFAETEEPSSPTGVLVNSNLPIASISDYRLLCDINKYVCNKISLLPNDEDSLPPLLVASGEKGSVPVVEEHPSHEQIILLLEGEGFHPVTFVLNANLLVNVKFIFYSSDKYWYFSTNGLHGLGQAEIIILLLCLPNEDTIPKDIFRLFITIYKDALKGKYIENLDNITFTESFLSSKDHGGFLFITPTFQKLDDLSLPSNPFLCGILIQKLEIPWAKVFPMRLMLRLGAEYKAYPAPLTSIRGRKPLFGEIGHTIMNLLVDLRNYQYTLHNIDQLLIHMEMGKSCIKIPRKKYSDVMKVLNSSNEHVISIGASFSTEADSHLVCIQNDGIYETQANSATGHPRKVTGASFVVFNGALKTSSGFLAKSSIVEDGLMVQITPETMNGLRLALREQKDFKITCGKVDAVDLREYVDICWVDAEEKGNKGVISSVDGISLQGFPSEKIKLEADFETDEKIVKCTEVFYFLKDQDLSILSTSYQFAKEIAMACSAALCPHLKTLKSNGMNKIGLRVSIDTDMVEFQAGSEGQLLPQHYLNDLDSALIPVIHGGTSNSSLPLEIELVFFIIEHLF

SEQ ID NO: 792945 - protein, 1539 aa, Homo sapiens; identical to SEQ ID NO: 792944

SEQ ID NO: 792946 - protein, 1582 aa, Homo sapiens
MDSYFKAAVSDLDKLLDDFEQNPDEQDYLQDVQNAYDSNHCSVSSELASSQRTSLLPKDQECVNSCASSETSYGTNESSLNEKTLKGLTSIQNEKNVTGLDLLSSVDGGTSDEIQPLYMGRCSKPICDLISDMGNLVHATNSEEDIKKLLPDDFKSNADSLIGLDLSSVSDTPCVSSTDHDSDTVREQQNDTSSELQNREIGGIKELGIKVDTTLSDSYNYSGTENLKDKKIFNQLESIVDFNMSSALTRQSSKMFHAKDKLQHKSQPCGLLKDVGLVKEEVDVAVITAAECLKEEGKTSALTCSLPKNEDLCLNDSNSRDENFKLPDFSFQEDKTVIKQSAQEDSKSLDLKDNDVIQDSSSALHVSSKDVPSSLSCLPASGSMCGSLIESKARGDFLPQHEHKDNIQDAVTIHEEIQNSVVLGGEPFKENDLLKQEKCKSILLQSLIEGMEDRKIDPDQTVIRAESLDGGDTSSTVVESQEGLSGTHVPESSDCCEGFINTFSSNDMDGQDLDYFNIDEGAKSGPLISDAELDAFLTEQYLQTTNIKSFEENVNDSKSQMNQIDMKGLDDGNINNIYFNAEAGAIGESHGINIICETVDKQNTIENGLSLGEKSTIPVQQGLPTSKSEITNQLSVSDINSQSVGGARPKQLFSLPSRTRSSKDLNKPDVPDTIESEPSTADTVVPITCAIDSTADPQVSFNSNYIDIESNSEGGSSFVTANEDSVPENTCKEGLVLGQKQPTWVPDSEAPNCMNCQVKFTFTKRRHHCRACGKVFCGVCCNRKCKLQYLEKEARVCVVCYETISKAQAFERMMSPTGSNLKSNHSDECTTVQPPQENQTSSIPSPATLPVSALKQPGVEVPAIGKKLTKASNKRVWELHFPDFQPGIQEPTVEGELGFEEAIGLCSKEQKRVWFADGILPNGEVADTTKLSSGSKRCSEDFSPLSPDVPMTVNTVDHSHSTTVEKPNNETGDITRNEIIQSPISQVPSVEKLSMNTGNEGLPTSGSFTLDDDVFAETEEPSSPTGVLVNSNLPIASISDYRLLCDINKYVCNKISLLPNDEDSLPPLLVASGEKGSVPVVEEHPSHEQIILLLEGEGFHPVTFVLNANLLVNVKFIFYSSDKYWYFSTNGLHGLGQAEIIILLLCLPNEDTIPKDIFRLFITIYKDALKGKYIENLDNITFTESFLSSKDHGGFLFITPTFQKLDDLSLPSNPFLCGILIQKLEIPWAKVFPMRLMLRLGAEYKAYPAPLTSIRGRKPLFGEIGHTIMNLLVDLRNYQYTLHNIDQLLIHMEMGKSCIKIPRKKYSDVMKVLNSSNEHVISIGASFSTEADSHLVCIQNDGIYETQANSATGHPRKVTGASFVVFNGALKTSSGFLAKSSIVEDGLMVQITPETMNGLRLALREQKDFKITCGKVDAVDLREYVDICWVDAEEKGNKGVISSVDGISLQGFPSEKIKLEADFETDEKIVKCTEVFYFLKDQDLSILSTSYQFAKEIAMACSAALCPHLKTLKSNGMNKIGLRVSIDTDMVEFQAGSEGQLLPQHYLNDLDSALIPVIHGGTSNSSLPLEIELVFFIIEHLF

SEQ ID NO: 792947 - protein, 1413 aa, Homo sapiens
MDSYFKAAVSDLDKLLDDFEQNPDEQDYLQDVQNAYDSNHCSVSSELASSQRTSLLPKDQECVNSCASSETSYGTNESSLNEKTLKGLTSIQNEKNVTGLDLLSSVDGGTSDEIQPLYMGRCSKPICDLISDMGNLVHATNSEEDIKKLLPDDFKSNADSLIGLDLSSVSDTPCVSSTDHDSDTVREQQNDTSSELQNREIGGIKELGIKVDTTLSDSYNYSGTENLKDKKIFNQLESIVDFNMSSALTRQSSKMFHAKDKLQHKSQPCGLLKDVGLVKEEVDVAVITAAECLKEEGKTSALTCSLPKNEDLCLNDSNSRDENFKLPDFSFQEDKTVIKQSAQEDSKSLDLKDNDVIQDSSSALHVSSKDVPSSLSCLPASGSMCGSLIESKARGDFLPQHEHKDNIQDAVTIHEEIQNSVVLGGEPFKENDLLKQEKCKSILLQSLIEGMEDRKIDPDQTVIRAESLDGGDTSSTVVESQEGLSGTHVPESSDCCEGFINTFSSNDMDGQDLDYFNIDEGAKSGPLISDAELDAFLTEQYLQTTNIKSFEENVNDSKSQMNQIDMKGLDDGNINNIYFNAEAGAIGESHGINIICETVDKQNTIENGLSLGEKSTIPVQQGLPTSKSEITNQLSVSDINSQSVGGARPKQLFSLPSRTRSSKDLNKPDVPDTIESEPSTADTVVPITCAIDSTADPQVSFNSNYIDIESNSEGGSSFVTANEDSVPENTCKEGLVLGQKQPTWVPDSEAPNCMNCQVKFTFTKRRHHCRACGKVFCGVCCNRKCKLQYLEKEARVCVVCYETISKAQAFERMMSPTGSNLKSNHSDECTTVQPPQENQTSSIPSPATLPVSALKQPGVEGLCSKEQKRVWFADGILPNGEVADTTKLSSGSKRCSEDFSPLSPDVAYVPVVEEHPSHEQIILLLEGEGFHPVTFVLNANLLVNVKFIFYSSDKYWYFSTNGLHGLGQAEIIILLLCLPNEDTIPKDIFRLFITIYKDALKGKYIENLDNITFTESFLSSKDHGGFLFITPTFQKLDDLSLPSNPFLCGILIQKLEIPWAKVFPMRLMLRLGAEYKAYPAPLTSIRGRKPLFGEIGHTIMNLLVDLRNYQYTLHNIDQLLIHMEMGKSCIKIPRKKYSDVMKVLNSSNEHVISIGASFSTEADSHLVCIQNDGIYETQANSATGHPRKVTGASFVVFNGALKTSSGFLAKSSIVEDGLMVQITPETMNGLRLALREQKDFKITCGKVDAVDLREYVDICWVDAEEKGNKGVISSVDGISLQGFPSEKIKLEADFETDEKIVKCTEVFYFLKDQDLSILSTSYQFAKEIAMACSAALCPHLKTLKSNGMNKIGLRVSIDTDMVEFQAGSEGQLLPQHYLNDLDSALIPVIHGGTSNSSLPLEIELVFFIIEHLF

SEQ ID NO: 792948 - protein, 1539 aa, Homo sapiens; identical to SEQ ID NO: 792944

SEQ ID NO: 792949 - protein, 1205 aa, Homo sapiens
MDSYFKAAVSDLDKLLDDFEQNPDEQDYLQDVQNAYDSNHCSVSSELASSQRTSLLPKDQECVNSCASSETSYGTNESSLNEKTLKGLTSIQNEKNVTGLDLLSSVDGGTSDEIQPLYMGRCSKPICDLISDMGNLVHATNSEEDIKKLLPDDFKSNADSLIGLDLSSVSDTPCVSSTDHDSDTVREQQNDTSSELQNREIGGIKELGIKVDTTLSDSYNYSGTENLKDKKIFNQLESIVDFNMSSALTRQSSKMFHAKDKLQHKSQPCGLLKDVGLVKEEVDVAVITAAECLKEEGKTSALTCSLPKNEDLCLNDSNSRDENFKLPDFSFQEDKTVIKQSAQEDSKSLDLKDNDVIQDSSSALHVSSKDVPSSLSCLPASGSMCGSLIESKARGDFLPQHEHKDNIQDAVTIHEEIQNSVVLGGEPFKENDLLKQEKCKSILLQSLIEGMEDRKIDPDQTVIRAESLDGGDTSSTVVESQEGLSGTHVPESSDCCEGFINTFSSNDMDGQDLDYFNIDEGAKSGPLISDAELDAFLTEQYLQTTNIKSFEENVNDSKSQMNQIDMKGLDDGNINNIYFNAEAGAIGESHGINIICETVDKQNTIENGLSLGEKSTIPVQQGLPTSKSEITNQLSVSDINSQSVGGARPKQLFSLPSRTRSSKDLNKPDVPDTIESEPSTADTVVPITCAIDSTADPQVSFNSNYIDIESNSEGGSSFVTANEDSVPENTCKEGLVLGQKQPTWVPDSEAPNCMNCQVKFTFTKRRHHCRACGKVFCGVCCNRKCKLQYLEKEARVCVVCYETISKAQAFERMMSPTGSNLKSNHSDECTTVQPPQENQTSSIPSPATLPVSALKQPGVEGLCSKEQKRVWFADGILPNGEVADTTKLSSGSKRCSEDFSPLSPDVPMTVNTVDHSHSTTVEKPNNETGDITRNEIIQSPISQVPSVEKLSMNTGNEGLPTSGSFTLDDDVFAETEEPSSPTGVLVNSNLPIASISDYRLLCDINKYVCNKISLLPNDEDSLPPLLVASGEKGSVPVVEEHPSHEQIILLLEGEGFHPVTFVLNANLLVNVKFIFYSSDKYWYFSTNGLHGLGQAEIIILLLCLPNEDTIPKDIFRLFITIYKDALKGKYIENLDNITFTESFLSSKDHGGFLFITPTFQKLDDLSLPSNPFLCGILIQKLEIPWAKVFPMRLMLRLGAEYKGKF

SEQ ID NO: 792950 - protein, 1233 aa, Homo sapiens [sequence omitted]

SEQ ID NO: 792951 - protein, 1083 aa, Homo sapiens
MDSYFKAAVSDLDKLLDDFEQNPDEQDYLQDVQNAYDSNHCSVSSELASSQRTSLLPKDQECVNSCASSETSYGTNESSLNEKTLKGLTSIQNEKNVTGLDLLSSVDGGTSDEIQPLYMGRCSKPICDLISDMGNLVHATNSEEDIKKLLPDDFKSNADSLIGLDLSSVSDTPCVSSTDHDSDTVREQQNDTSSELQNREIGGIKELGIKVDTTLSDSYNYSGTENLKDKKIFNQLESIVDFNMSSALTRQSSKMFHAKDKLQHKSQPCGLLKDVGLVKEEVDVAVITAAECLKEEGKTSALTCSLPKNEDLCLNDSNSRDENFKLPDFSFQEDKTVIKQSAQEDSKSLDLKDNDVIQDSSSALHVSSKDVPSSLSCLPASGSMCGSLIESKARGDFLPQHEHKDNIQDAVTIHEEIQNSVVLGGEPFKENDLLKQEKCKSILLQSLIEGMEDRKIDPDQTVIRAESLDGGDTSSTVVESQEGLSGTHVPESSDCCEGFINTFSSNDMDGQDLDYFNIDEGAKSGPLISDAELDAFLTEQYLQTTNIKSFEENVNDSKSQMNQIDMKGLDDGNINNIYFNAEAGAIGESHGINIICETVDKQNTIENGLSLGEKSTIPVQQGLPTSKSEITNQLSVSDINSQSVGGARPKQLFSLPSRTRSSKDLNKPDVPDTIESEPSTADTVVPITCAIDSTADPQVSFNSNYIDIESNSEGGSSFVTANEDSVPENTCKEGLVLGQKQPTWVPDSEAPNCMNCQVKFTFTKRRHHCRACGKVFCGVCCNRKCKLQYLEKEARVCVVCYETISKAQAFERMMSPTGSNLKSNHSDECTTVQPPQENQTSSIPSPATLPVSALKQPGVEVPAIGKKLTKASNKRVWELHFPDFQPGIQEPTVEGELGFEEAIGLCSKEQKRVWFADGILPNGEVADTTKLSSGSKRCSEDFSPLSPDVPMTVNTVDHSHSTTVEKPNNETGDITRNEIIQSPISQVPSVEKLSMNTGNEGLPTSGSFTLDDDVFAETEEPSSPTGVLVNSNLPIASISDYRLLCDINKYVCNKISLLPNDEDSLPPLLVASGEKGSGREAVI

SEQ ID NO: 792952 - protein, 101 aa, Homo sapiens
GRLAKQVYPTRPGRRAEAAAGAARPQNPDNPFKALRKSKKFLVNCSWYQGSDQRTRPFQQSGACSDRRAPPSVSVRSLWVRLVFGGFPGKASLWLPPFSPK

SEQ ID NO: 792953 - protein, 53 aa, Homo sapiens
MQKFITLKSLYISYYDRDPRYLTWRILLIQFKQYVANRYYRIKYNDRNISIST

SEQ ID NO: 792954 - protein, 116 aa, Homo sapiens
MAKSKNHTTHNQSRKWHRNGIKKPRSQRYESLKGVDPKFLRNMRFAKKHNKKGLKKMQANNAKAMSARAEAIKALVKPKEVKPKIPKGVSRKLDRLAYIAHPKLGKRARARIAKGL

SEQ ID NO: 792955 - protein, 144 aa, Homo sapiens
ATTCVQSLGQGKSDVVGSLALQSAGESRLWQGHHATKSEHSLSPADLGSHTSPKESSEALDAAAVLSVAECVERMAPTLPKSDLNEVKKLLKTNKTLAKMLGHIFEMNDNDPRKEEEIWKYSEYMADLTQRGRMENISCFMSSL

SEQ ID NO: 792956 - protein, 67 aa, Homo sapiens
KECLVQQEAQGKCLGNGTTVIITHLAACYKVNEIMDTKCKLDEHKGLLYRPVCPEENWCPKVCPAEN

SEQ ID NO: 792957 - protein, 120 aa, Homo sapiens
QFCRLYRKHSGICFWRGLRELLLMTEGKAGAGASHGESRSKRERVCWGRCTTMETAPSHEGFDPVIQTLPTRLHLQHWGSRFNMRFGRDIQTISSVSLIQDHMIRSSLLSSNRLNSTFSV

SEQ ID NO: 792958 - protein, 41 aa, Homo sapiens
MSAYTSYLIYFVFHGVSDYFSKHEYITKLSYSSQYGQTSPH

SEQ ID NO: 792959 - protein, 85 aa, Homo sapiens
RYYVREAGRCGWQIVRGIIQLDGFRDMEITRLLETFFEVAVLVKFFTFTKGMALQRAQAPAQEPALHQERLQVLSDVLGSVLFPW

SEQ ID NO: 792960 - protein, 69 aa, Homo sapiens
MSTCCWCTPGGASTIDFLKRYASNTPSGEFQTADEDLCYCLECVAEYHKARDELPFLHEVKYIRWAIFF

SEQ ID NO: 792961 - protein, 88 aa, Homo sapiens
MRAGHRQVQGGQEGSLAVRQLLVQPRLSLLLGHLLQTQSSAQECLVVKLQPCGSLFSEVNSVFTDKGKVPGESCSLNVHPHESELSLQ

SEQ ID NO: 792962 - protein, 67 aa, Homo sapiens
NGPHTHPAFCLSDPMAETEGPSTAAQSGALAVTSPVFTVERIYCPCRADALQGAEPPALSPLGVNKH

SEQ ID NO: 792963 - protein, 102 aa, Homo sapiens
ENWQSNYVFIELVQFIFHMMSITGSVSLIRMLEIQNAPICETWGHKFHIWVYFEFICMHEFLQKIGNPTMFLLNCAIYFPHDVYYRFSIPDQNVGNPKCPHM

SEQ ID NO: 792964 - protein, 102 aa, Homo sapiens
PASALPKCWDYRRDHRARPYFDFYSVRFSRMLTLLPLEPGTPKNKIHGGGGKELMYSVCGQPSSLVHLLFSVQTEERVSWNWSLSLPLFSSERVQCKSFFTH

SEQ ID NO: 792965 - protein, 87 aa, Homo sapiens
AAAASAASSSSASSSSSSSSSASSGPALLRVGPGFDAALQVSAAIGTNLRRFRAVFGESGGGGGSGEVPQLKRDEETLETVLRRLKR

SEQ ID NO: 792966 - protein, 103 aa, Homo sapiens
MTKTKACLGYPVGAVEAALVIWSGSGAIPCHRGLCSLTTSSARPGHFIHGMDVALVLLILIVFGASFFTPSAARILSSAVLCFDFPFCPFSQGRRLHTAASGG

SEQ ID NO: 792967 - protein, 365 aa, Homo sapiens
MDRAALLGLARLCALWAALLVLFPYGAQGNWMWLGIASFGVPEKLGCANLPLNSRQKELCKRKPYLLPSIREGARLGIQECGSQFRHERWNCMITAAATTAPMGASPLFGYELSSGTKETAFIYAVMAAGLVHSVTRSCSAGNMTECSCDTTLQNGGSASEGWHWGGCSDDVQYGMWFSRKFLDFPIGNTTGKENKVLLAMNLHNNEAGRQAVAKLMSVDCRCHGVSGSCAVKTCWKTMSSFEKIGHLLKDKYENSIQISDKTKRKMRRREKDQRKIPIHKDDLLYVNKSPNYCVEDKKLGIPGTQGRECNRTSEGADGCNLLCCGRGYNTHVVRHVERCECKFIWCCYVRCRRCESMTDVHTCK

SEQ ID NO: 792968 - protein, 372 aa, Homo sapiens
PAKTTEGKARKMERHPPMQLTTCLRETLFTGASQKTSLWWLGIASFGVPEKLGCANLPLNSRQKELCKRKPYLLPSIREGARLGIQECGSQFRHERWNCMITAAATTAPMGASPLFGYELSSGTKETAFIYAVMAAGLVHSVTRSCSAGNMTECSCDTTLQNGGSASEGWHWGGCSDDVQYGMWFSRKFLDFPIGNTTGKENKVLLAMNLHNNEAGRQAVAKLMSVDCRCHGVSGSCAVKTCWKTMSSFEKIGHLLKDKYENSIQISDKTKRKMRRREKDQRKIPIHKDDLLYVNKSPNYCVEDKKLGIPGTQGRECNRTSEGADGCNLLCCGRGYNTHVVRHVERCECKFIWCCYVRCRRCESMTDVHTCK

SEQ ID NO: 792969 - protein, 283 aa, Homo sapiens
MAPSLTWQLLSLLVKEAQPLVWVKDPLQLTSNPLGPPEPWSSRSSHLPWESPHAPAPPAAPGDFDYLGPSASSQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAQRSFYSS

SEQ ID NO: 792970 - protein, 47 aa, Homo sapiens
MASCRRRGVTRVFLSRAALPANSRILAVRYSSTASRYTGAPARTRLA

SEQ ID NO: 792971 - protein, 242 aa, Homo sapiens
MGNILTCRVHPSVSLEFDQQQGSVCPSESEIYEAGAEDRMAGAPMAAAVQPAEVTVEVGEDLHMHQVRDREMPEALEFNLSANPEASTIFQRNSQTDALEFNPSANPEASTIFQRNSQTDVVEIRRSNCTNHVSTERFSQQYSSCSTIFLDDSTAIQHYLTMTIISVTLEIPHHITQRDADRSLSIPDEQLHSFAVSTVHIMKKRNGGGSLNNYSSSIPPTPSTSQEDPQFSVPPTANTPTP

SEQ ID NO: 792972 - protein, 147 aa, Homo sapiens
MGNILTCRVHPSVSLEFDQQQGSVCPSESEIYEAGAEDRMAGAPMAAAVQPAEVTVEVGEDLHMHQVRDREMPEALEFNLSANPEASTIFQRNSQTDALEFNPSANPEASTIFQRNSQTDVVEIRRSNCTNHCDLGDTSSYHTKRCR

SEQ ID NO: 792973 - protein, 66 aa, Homo sapiens
PMAAAVQPAEVTVEVGEDLHMHQVRDREMPEGKEVIGAIYPRFASGLLLSPRFPLRHPTLRAPFCL

SEQ ID NO: 792974 - protein, 122 aa, Homo sapiens
MPPDLLHLVHSICLESIPCPTREQLITIDSLQIAWTLEHPCTSCLAYSPPVYPLLCEPLALPELQDNSWFYLLGSHWVVGFQRAGLSCSFVAPIPVPPQCLVRRRYKQLLKEDICKFYLQKN

SEQ ID NO: 792975 - protein, 73 aa, Homo sapiens
MIMPLHSTLEDEVRSHLKNKTKPNTFGLSTGRNGNATGGLGNQEDAKYSVKCFMHIISFNPQDSIIETIIFIL

SEQ ID NO: 792976 - protein, 74 aa, Homo sapiens
SASMLCNSFLPSQGMTAPTGVGSLHPWILPAEAVEKAVDKEHQKDFRDFNALRYLTITLVPKLHYLKKDLYMET

SEQ ID NO: 792977 - protein, 78 aa, Homo sapiens
GSRGPPRVLFPAARNLSVHRAPPRCARNFRCSPTTSLLRAFEHAACSACPDLRLGDSCCTSKPTGGNTSSRKPSLMPL

SEQ ID NO: 792978 - protein, 141 aa, Homo sapiens
RRRKLIRSDGKQVTGCLSGMGQRREESGLRRGHNKETWWGGYEYPFFFFAFLETGSCSVTQLIAHCILKLQGPRDLPAKQLGLQAQPTMPGCFFSFGGDEVSLCCLGLVLNSWSQGNPPTYDSQSTGITGVSHLAQPCSLS

SEQ ID NO: 792979 - protein, 317 aa, Homo sapiens
ARGKMASFRKLTLSEKVPPNHPSRKKVNFLDMSLDDIIIYKELEGTNAEEEKNKRQNHSKKESPSRQQSKAHRHRHRRGYSRCRSNSEEGNHDKKPSQKPSGFKSGQHPLNGQPLIEQEKCSDNYEAQAEKNQGQSEGNQHQSEGNPDKSEESQGQPEENHHSERSRNHLERSLSQSDRSQGQLKRHHPQYERSHGQYKRSHGQSERSHGHSERSHGHSERSHGHSERSHGHSKRSRSQGDLVDTQSDLIATQRDLIATQKDLIATQRDLIATQRDLIVTQRDLVATERDLINQSGRSHGQSERHQRYSTGKNTITT

SEQ ID NO: 792980 - protein, 160 aa, Homo sapiens
ATAFSQQDLLDGAVLYSHNSSLSPRDTMAFSVEMGPVHTDATLQVTIALEGPLAPLKLVRHKKIYVFQGEAAEIRRDQLEAAQEAVPPADIIFSVKSPPSASYLVMVSRGALADEPPSLDPVQSFSQEAVDTGRVLYLHSRPEAWSDAFSLDVASGLDAP

SEQ ID NO: 792981 - protein, 82 aa, Homo sapiens
RGLCGEGGDPGLETGGERLLDAEQVLGRGRTAAYITIAVMLSQASTWAGLGAGQAQLPVSCEAWSGAFTRPGRRRLSRRLKL

SEQ ID NO: 792982 - protein, 84 aa, Homo sapiens
AVSTVGGHHMFAVRGTQCPQQVRSVLHSGSFPVPGPELRAVKWLCPWPHGASTLEAKMDFKEITQMITSGMYLTPLGKRLLLAS

SEQ ID NO: 792983 - protein, 132 aa, Homo sapiens
MQCPQGSRVSHGAGAHVWVPGAGVLSAPERLRERPRSHTGPCWPSLCLGPSTPHSVRVNLAGTQEGKVQPEAGRRQEGLLPCDLQSPCGNQPAFLGVLLAREPAQPLPGLRVLISSSWEGSRGSEQSDSSNQ

SEQ ID NO: 792984 - protein, 112 aa, Homo sapiens
PSPFPTLLELAAFFSALPSSPGECRQRRQRPLASEARGTSQPVQGSLSCPQLVGLGLQRFQWSLMSLSTCPLGSGQMGPVAKANGQTWLPPPPRDLSSREGKQPFPHRHPFC

SEQ ID NO: 792985 - protein, 129 aa, Homo sapiens
LGRWPFVLHKMDLRKLFSAFFPSSCPEVSAQPLPAHWILVAILGPRQDGGTQDASCLGGWEPTTVLQDPTLSAPWTFIFPFGKRAFQHPSSKGQCFLRRGIQGFEVRPTRCMCLPAPCMALGTIGRLQI

SEQ ID NO: 792986 - protein, 198 aa, Homo sapiens
MWNTLTRSLSDHPVGKDPQAMRTGQRQNKGMRTRLGCLSHKSDSCSDFTAILPDKPNRALKRLSTEEATRWADSFDVLLSHKYGVAAFRAFLKTEFSEENLEFWLACEEFKKTRSTAKLVSKAHRIFEEFVDVQAPREVNIDFQTREATRKNLQEPSLTCFDQAQGKVHSLMEKDSYPRFLRSKMYLDLLSQSQRRLS

SEQ ID NO: 792987 - protein, 180 aa, Homo sapiens
MAALLMPRRNKGMRTRLGCLSHKSDSCSDFTAILPDKPNRALKRLSTEEATRWADSFDVLLSHKYGVAAFRAFLKTEFSEENLEFWLACEEFKKTRSTAKLVSKAHRIFEEFVDVQAPREVNIDFQTREATRKNLQEPSLTCFDQAQGKVHSLMEKDSYPRFLRSKMYLDLLSQSQRRLS

SEQ ID NO: 792988 - protein, 114 aa, Homo sapiens
HFSYSLMWVLTSNDADAQHVRFVKDAPSLCHESMASSPPWKATGSLLESQDKFNILPKSQATRGEEMKSLQTLHFAGENLQVCPRILTLVHLAELHGEKTAVNGEFRGMGFSLL

SEQ ID NO: 792989 - protein, 101 aa, Homo sapiens
MGHFDFLSAALAKELGVCVEGSSGLKKVVSIYQWRTLSTPSPRPAITTGVRVGCDAYRINVTETLCPHQSLGLQPRDGSSPNHDDEFFWEEYEPASGMTDR

SEQ ID NO: 792990 - protein, 239 aa, Homo sapiens
RLSPLLYSILSKYSVLGVRLPRSLHKMPGEATETVPAIEQQLLQPQAETGSGTESDSDESVPELEEQDSTQVTAQVQLVVAAEIDEEPVSKAKQRRSEKKARKARFKLGLQQVTGVTRVTIRKSKNILFVITKPDVYKSPASDTYMVFGEAKIEDLSQEAQLAAAEKFKVQGEAVSNIQENTQTPTVQEGSEDEEVDETGVEIKDIELVLSQANVWGAKAVRALKNSNDIVNAIMELTM

SEQ ID NO: 792991 - protein, 239 aa, Homo sapiens; identical to SEQ ID NO: 792990

SEQ ID NO: 792992 - protein, 132 aa, Homo sapiens
PDIDLVWGAESLTFQGKPLSLLNSTWERVKPRPWVNICNSCCLDLDQGHFAFHPLSLHFFPQVAFWVTEEAVGFQDVLLARQLQAYLALRASLKDERFPLLAQGFPKSWCLLLLPVFLSKPRDGAQACYREK

SEQ ID NO: 792993 - protein, 67 aa, Homo sapiens
IIGHTDLRCTVQIILANACTHVAHTPIKIENIAITPENSESTLPLDSSSPYLMSVMTYYCHPFWNIM

SEQ ID NO: 792994 - protein, 68 aa, Homo sapiens
NDIDQYPVVFRNASDQGSWMQLEMLLRKLSDLVWTSDALSDRFWKMVWFPSGVEDSKDTVTLFGFGSE

SEQ ID NO: 792995 - protein, 130 aa, Homo sapiens
ASGPHLALGQLWTLCRQWLRPEARSKEQMLELLVLEQFLGALPSKMRTWVQSQGPRSCREAASLVEDLTQMCQQEGERRRLPAPGRARGPDVSEDRTALLPAHIAPTPARPLPTSKPLLPRGCVFNYFYI

SEQ ID NO: 792996 - protein, 85 aa, Homo sapiens
KESSPDRVVLIFWPRLGRFSLPGRSQGDCARERHACGVNGWVLGALGTAGVLAGLRLPYVFDTVGTHNMLLLCCRQFTRVALNRS

SEQ ID NO: 792997 - protein, 193 aa, Homo sapiens
MDMTWEKRLAKKYYDKLFKEYCIADLSKYKENKFGFRWRVEKEVISGKGQFFCGNKYCDKKEGLKSWEVNFGYIEHGEKRNALVKLRLCQECSIKLNFHHRRKEIKSKKRKDKTKKDCEESSHKKSRLSSAEEASKKKDKGHSSSKKSEDSLLRNSDEEESASESELWKGPLPETDEKSQEEEFDEYFQDLFL

SEQ ID NO: 792998 - protein, 89 aa, Homo sapiens
TWEEAGEKMPSESLCLAAQARLDTEMVENRYTDGSVEPSGTKKEDLNDKEKKNEDETPAPVYRAKSILETWVWVKQPGNLSFGTLESLI

SEQ ID NO: 792999 - protein, 103 aa, Homo sapiens
PPYRPPDLIFRPNWFCCVSLSSLVNRGDARRTSGVWAGMGPPGLGRRVIHGLIGGIRCTLGTEGRTWLKDQFPVAEGHLLEHQRLLQMCPQECQQGEPAGAQV

SEQ ID NO: 793000 - protein, 123 aa, Homo sapiens
ACLMDMNALLDRFHNYILPHLRGEDRVCHCNCGRHHIHYVIPYDGDQSVVDASENYFVTDSVTKQEIDLMLGLLLGFCISWFLVWMDGVLHCAVRAWRAGRRYDGSWTWLPKLCSLRELGRRP

SEQ ID NO: 793001 - protein, 123 aa, Homo sapiens
RAGGQRGLGVVLPSSFAKLLSFPQRYHPAGQPTLAATGVHLPSLQQTTFRSLISCCSGNIWIRDFSKPLSPSSPPPPGPNSCPSHPSPCSPCPPPTPLEWPFIKPKPKKPTDLAVTTTPGPGS

SEQ ID NO: 793002 - protein, 120 aa, Homo sapiens
ALTGSPGWERAPQEGCELRTRKNATASWGLFLMCRFQISTMLQKSSNRCAPSKLATDHIQKLDFLLFWEYLDQRPCCHHYSGTWKLKRGRDGETQKAERLLFFHNTGFVDVATIRTRTAC

SEQ ID NO: 793003 - protein, 73 aa, Homo sapiens
RREGISMLVGPKTYLWPYKSFPNCLIFSAFRLWHLERNALYLLKDGISHLNPGFLTFRTSPATVSNKMFSAAS

SEQ ID NO: 793004 - protein, 47 aa, Homo sapiens
MCQHRVQYRAASCKECASSCQAPHCGLSLRGSISIFIASLATERDCL

SEQ ID NO: 793005 - protein, 36 aa, Homo sapiens
MITLGFCLRSLEWSFPSAFKKVLHSSLGYEAKIQLN

SEQ ID NO: 793006 - protein, 133 aa, Homo sapiens
LAYGPRSLNSVPRREVEVLEPRLGFLSGCPAPAAPGLPPTPHTTGRQLGPGIITVQHTCPVNRRCAQNRCRLYSPPSPFCVTPRANYSTNFCPPCSQFSCMGLLFRTQNTNSLGSITNVHPFRNCAFSNRTMG

SEQ ID NO: 793007 - protein, 128 aa, Homo sapiens
ALCIRTRPVSVAPGGDLGGGMPGTTRPEFCPVTAPKMGWGGPKLTLQGEVATSISSPPRSGSTDLLRGTAGSQGLQPPAAPSLCPEFPATLCPRPHAALFTPFAWPAVGSAFEVLFSGPTGIFAQNQN

SEQ ID NO: 793008 - protein, 271 aa, Homo sapiens
TLRPPSLPATTVRVWPAVGKEERSQGGEAWIRSLLHPPRAAHLTVAEAGAVAEAVVGAVAVAGGALEPLGRPCPAPPAAASSVSPTTSPPPAPGLEPHCRELPGTPTGTEPRVMRPKCRSRTGPRHTIVPDQPERRTQGTTEPPTGGMTHEPWTTAHFPEPAQLRRHLAQEHAGGEVELAIERVAKETAEPSWGPQDEGSEPPTTAAAGATEEEAVAAWPETWPAGEPSTLAAPTSAAEPRESESEEAEAGAAELRAELALAAGRQEEKQV

SEQ ID NO: 793009 - protein, 243 aa, Homo sapiens
HPTHLFLSLPRFPSLPSLPTGMDPQPPPPAQGSPPHRGRGRGRGRGRGRGRGRGRGGAGAPRAPLPCPTCGRLFRFPYYLSRHRLSHSGLRPHACPLCPKAFRRPAHLSRHLRGHGPQPPLRCAACPRTFPEPAQLRRHLAQEHAGGEVELAIERVAKETAEPSWGPQDEGSEPPTTAAAGATEEEAVAAWPETWPAGEPSTLAAPTSAAEPRESESEEAEAGAAELRAELALAAGRQEEKQV

SEQ ID NO: 793010 - protein, 79 aa, Homo sapiens
TPESLLYLRHCLLSDIFLFRQPCKCLARMTNELDFRGDVTVHKHSLEHAQCSGVHGTVQMPECAVGLDRDHCCRNKMQF

SEQ ID NO: 793011 - protein, 125 aa, Homo sapiens
RLEKKDLKLEPPEEEIIEGNTKSHIMLVQRQMSVIEEDLEEFQLALKHYVESASSQSGCLRISIQKLSNESRYMIYEFWENSSVWNSHLQTNYSKTFQRSNVDFLETPELTSTMLVPASWWILNN

SEQ ID NO: 793012 - protein, 84 aa, Homo sapiens
LCAWGRLCGLRAALSPQESLASEEGGSTTGGITVRHLPPALPPSCSQPPAPGRDWRATGSTARPQPPIKLELKTVIAWMFSSYI

SEQ ID NO: 793013 - protein, 364 aa, Homo sapiens
MNIIRENKDLACFYTTKHSWRGKYKRVFSVGTHAITTYNPNTLEVTNQWPYGDICSISPVGKGQGTEFNLTFRKGSGKKSETLKFSTEHRTELLTEALRFRTDFSEGKITGRRYNCYKHHWSDSRKPVILEVTPGGFDQINPATNRVLCSYDYRNIEGFVDLSDYQGGFCILYGGFSRLHLFASEQREEIIKSAIDHAGNYIGISLRIRKEPLEFEQYLNLRFGKYSTDESITSLAEFVVQKISPRHSEPVKRVLALTETCLVERDPATYNIATLKPLGEVFALVCDSENPQLFTIEFIKGQVRKYSSTERDSLLASLLDGVRASGNRDVCVKMTPTHKGQRWGLLSMPVDEEVESLHLRFLAT

SEQ ID NO: 793014 - protein, 376 aa, Homo sapiens
TSGPGFRVVGSVGIPALSSAREKPTPPAMPAPPCASCHAARAALRRPLSGQALCGACFCAAFEAEVLHTVLAGRLLPPGAVVAVGASGGKDSTVLAHVLRALAPRLGISLQLVAVDEGIGGYRDAALAAVRRQAARWELPLTVVAYEDLFGGWTMDAVARSTAGSGRSRSCCTFCGVLRRRALEEGARRVGATHIVTGHNADDMAETVLMNFLRGDAGRLARGGGLGSPGEGGALPRCRPLQFASQKEVVLYAHFRRLDYFSEECVYAPEAFRGHARDLLKRLEAARPSAVLDLVHSAERLALAPAARPPRPGACSRCGALASRALCQACALLDGLNRGRPRLAIGKGRRGLDEEATPGTPGDPARPPASKAVPTF

SEQ ID NO: 793015 - protein, 138 aa, Homo sapiens
DARGSGPAPRLQGRPHLLATSGLPPGSDAAGWGLPVNDTVNKPVTLPGLPCGVGKETGAHSPETLKKLGPQTSRSQGRRVSNWASGSEGGGGWGTILGLREERARTKPRRSGTGDPRHLWLRKEGLGSWTPGSQGGGG

SEQ ID NO: 793016 - protein, 437 aa, Homo sapiens
MRGYHGDRGSHPRPARFADQQHMDVGPAARAPYLLGSREAFSTEPRFCAPRAGLGHISPEGPLSLSEGPSVGPEGGPAGAGVGGGSSTFPRMYPGQGPFDTCEDCVGHPQGKGAPRLPPTLLDQFEKQLPVQQDGFHTLPYQRGPAGAGPGPAPGTGTAPEPRSESPSRIRHLVHSVQKLFAKSHSLEAPGKRDYNGPKAEGRGGSGGDSYPGPGSGGPHTSHHHHHHHHHHHHQSRHGKRSKSKDRKGDGRHQAKSTGWWSSDDNLDSDSGFLAGGRPPGEPGGPFCLEGPDGSYRDLSFKGRSGGSEGRCLACTGMSMSLDGQSVKRSAWHTMMVSQGRDGYPGAGPGKGLLGPETKAKARTYHYLQVPQDDWGGYPTGGKDGEIPCRRMRSGSYIKAMGDEESGDSDGSPKTSPKAVARRFTTRRSSSVDQARI

SEQ ID NO: 793017 - protein, 72 aa, Homo sapiens
RLKEEKSKSKALRQEHTGHVQASGAMGYLHFTVQPWTLPPSMSNRRTPRNKSNTRTSSNLETKARGHVNYIN

SEQ ID NO: 793018 - protein, 104 aa, Homo sapiens
TSPFELEEFYTFALVVLTLFPEEQLHPFRSGRTLHSSPSRHGCIWHHHFCSTIEASTHDGAARVVPATCPGKQEHLTVCDRSSILFLLQHLWSATTSQVPVLTW

SEQ ID NO: 793019 - protein, 103 aa, Homo sapiens
ASAQKRYVLIANTQGECDADQCCGCQRTRLHQTITSQSHLQFFALNAKLWPRIGGAACAKTQVRSHIPQAVVATFISGKAQQRNVTPGTPKFGLFLYEHLEDL

SEQ ID NO: 793020 - protein, 149 aa, Homo sapiens
MHPQAHEPGVRREGHRRHRWRQLQPGGGAGAARSHAEGGGHPAQGLRAPQHQMKRGELFDYLTEKVTLSEKETRKIMRALLEVICTLHKLNIVHRDLKPENILLDDNMNIKLTDFGFSCQLEPGERLRGLVTWPWPTSRPRVLNQPSAE

SEQ ID NO: 793021 - protein, 387 aa, Homo sapiens
MTRDEALPDSHSAQDFYENYEPKEILGRGVSSVVRRCIHKPTSQEYAVKVIDVTGGGSFSPEEVRELREATLKEVDILRKVSGHPNIIQLKDTYETNTFFFLVFDLMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 793022 - protein, 333 aa, Homo sapiens
MHPQAHEPGVRREGHRRHRWRQLQPGGGAGAARSHAEGGGHPAQGLRAPQHQMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 793023 - protein, 333 aa, Homo sapiens; identical to SEQ ID NO: 793022

SEQ ID NO: 793024 - protein, 333 aa, Homo sapiens; identical to SEQ ID NO: 793022

SEQ ID NO: 793025 - protein, 169 aa, Homo sapiens
MAACCCCRCPRLVLLFFLSGTRFIISFCRAVVVSSSLTCVLLHDQASSPRVGPPGGYIIRHCRLSLDYCVSVVVSPVLCSAAPLGFFVVWLVLFVCRALSCVVIVMSVLVGVNTLCGDLFVPPEQGPLDHWWVTAVYSYTDKVFGRIWEKGGRTVESGSHHPLIPRTFW

SEQ ID NO: 793026 - protein, 333 aa, Homo sapiens; identical to SEQ ID NO: 793022

SEQ ID NO: 793027 - protein, 68 aa, Homo sapiens
CQELETKATCNKRCFRYPYQEIARVLGALCQEYGTKNYGYQRLERVLGMGYKKELVNGYNNTVRRNMI

SEQ ID NO: 793028 - protein, 123 aa, Homo sapiens
RVGLLACREVHWILQTAFRRQCLIYIGAKDWLDQVWMFTQLRRKLANLQLCKWSTCQHHVACSLLYTWFTKKREDGATILNMCPFQVAPFPISRAAGIYSCKLPARLSMSAAQSYRLLFVKKK

SEQ ID NO: 793029 - protein, 139 aa, Homo sapiens
TALALEGCPLPQPHSDSSCRSRMGLSSPGHGLSPYLNLGTVVGRTMWDKKVLCPTQHQSQGGLGISRGSWKGGRTQLKSQNLGRTFSGKPLQMSSGMSMVAHTCRLNTLVKLRLEDCSRPGVEDQPGQHSKTLSLCVFF

SEQ ID NO: 793030 - protein, 86 aa, Homo sapiens
MAIVKPAVARANRGAKFAQEATLMPFLKNYSWLNPDLWLGTMSSPSLPNQEYMTHLRPTKLRGVIQPLRPTTAFTAIVHSAKRHAK

SEQ ID NO: 793031 - protein, 86 aa, Homo sapiens
MAIVKPAVARANRGAKFAQRATLMPFLKNYSWLNPDLWLGTMSSPSLPNQEYMTHLRPTKLRGVIQPLRPTTAFTAIVHSAKRHAK

SEQ ID NO: 793032 - protein, 86 aa, Homo sapiens; identical to SEQ ID NO: 793031

SEQ ID NO: 793033 - protein, 86 aa, Homo sapiens; identical to SEQ ID NO: 793031

SEQ ID NO: 793034 - protein, 188 aa, Homo sapiens
AVEGLMLGLQVDHHAQLIKNNFLVKMGSRHVAQAGLELLGLSFPPASVFQGVGITGMSHLTLQKAVWVERASAAHPGALMWEPHPWVRQRGPRCAPTGWPCRPDGTAACAPRPPRENSENPQMSLHLLQRQGLRTYPLLSTCSGVISAHCSLRLQVQENCLNLGGRGCSEPRLHHSTPAWATERDSIS

SEQ ID NO: 793035 - protein, 152 aa, Homo sapiens
PWFPLLPAVARAGFLEQRQRILLRLLRMSRFRGCSSSGVRFCSAEREASGSGRGNVLQFVQEPQAQQSRPFPAGAQLSLELLFSDWGMEWAQPRLPKPALPLPVVVAFSRAADCAVDHHFRFCLLLRLLRQLLTLLRDEEREVNPWQRKIVV

SEQ ID NO: 793036 - protein, 140 aa, Homo sapiens
ERCYGRARAPEGGWKPRTVGRVEGDRDRWGERPPWPVLPSPPFLRYREELPAAIRGRAEKHVTGSWSGCWPGSLTVKGGPPRGQGLRSAGLHWGVASAGRVSPVGAGPPWWVQHPRHPDLASHRGALPATSAAAGGHQSP

SEQ ID NO: 793037 - protein, 167 aa, Homo sapiens
MSLALRSELVVDKTKRKKRRELSEEQKQEIKDAFELFDTDKDEAIDYHELKVAMRALGFDVKKADVLKILKDYDREATGKITFEDFNEVVTDWILERDPHEEILKAFKLFDDDDSGKISLRNLRRVARELGENMSDEELRAMIEEFDKDGDGEINQEEFIAIMTGDI

SEQ ID NO: 793038 - protein, 167 aa, Homo sapiens; identical to SEQ ID NO: 793037

SEQ ID NO: 793039 - protein, 167 aa, Homo sapiens; identical to SEQ ID NO: 793037

SEQ ID NO: 793040 - protein, 156 aa, Homo sapiens
MSLALRSELVVDKTKRKKRRELSEEQKQEIKDAFELFDTDKDEAIDYHELKVAMRALGFDVKKADVLKILKDYDREATGKITFEDFNEVVTDWILERDPHEEILKAFKLFDDDDSGKISLRNLRRVARELGENMSDEELRAMIEEFDKDGDGESKF

SEQ ID NO: 793041 - protein, 111 aa, Homo sapiens
MSLALRSELVVDKTKRKKRRELSEEQKQEIKDAFELFDTDKDEAIDYHELKVAMRALGFDVKKADVLKILKDYDREATGKITFEDFNEVGVYFNSLCNQQLLGNCLINITF

SEQ ID NO: 793042 - protein, 167 aa, Homo sapiens; identical to SEQ ID NO: 793037

SEQ ID NO: 793043 - protein, 98 aa, Homo sapiens
PPIQLGSLVTQEAPAQDSLGSWINSSPDSSENLSEIPLSHKERKEILTGTKCIWVKAARRRSRALGTEGRHLLAPATERSSLSLHSLSEGDDARPPGP

SEQ ID NO: 793044 - protein, 71 aa, Homo sapiens
GSLGTQRLTRTSSGEAAGEQAHPAQNALERAGQSTRLLLTRAARGSPTRGSRPCTHDGEGGGFPLSSAERS

SEQ ID NO: 793045 - protein, 109 aa, Homo sapiens [sequence omitted]

SEQ ID NO: 793046 - protein, 77 aa, Homo sapiens
LKERDLEDCSVRGQSLRGSGGTIPLRLLERRPVSATRIQNCTHFESSTQGGSDPCLAQRCCIFLSLSERRAQCPGRG

SEQ ID NO: 793047 - protein, 302 aa, Homo sapiens
MLAAWFRMKYPHMVVGALAASDPYLEFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFTMVELEPWSRKWVTQDITETLVAVTISEGPPLRFRDKKVDLFEVYRAGGTYTNGPHLNGE

SEQ ID NO: 793048 - protein, 302 aa, Homo sapiens
MLAAWFRMKYPHMVVGALAASDPYLEFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFKQWWNLDPWSGGGVTKDFTDTLVAVTISEGAHNLDLRTKNAWILCLGCNPSLELDLRMVQ

SEQ ID NO: 793049 - protein, 238 aa, Homo sapiens
MLAAWFRMKYPHMVVGALAASDPYLEFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGMVRRWSN

SEQ ID NO: 793050 - protein, 175 aa, Homo sapiens
MIEMLEERALGRYRPDLNPHSSCFGPCNSRLPLNPLSSINTWLSRNNYDLGPGPSGIFTPNWKPLHQDVCRDVSPWSGILSHLAPPQRGPLSSANLHRYHHDFPIEGIPRKQFLFSLLVQFSPEKVTFLTRLVSEKPLRCQLPVCPGPPDTFLCCVCLRNTFPRLSPTGFQQVQP

SEQ ID NO: 793051 - protein, 128 aa, Homo sapiens
FGYGSDLLVTILIFMDQQITAVIVNRKENKLKKAAGYHLDLFWVGILMALCSFMGLPWYVAATVISIAHIDRSHIDHHMPSTLNVSQFTYTFEGDTTIISILQRRKLSLGEMTRFPKLTQLARSRAWI

SEQ ID NO: 793052 - protein, 80 aa, Homo sapiens
GPRWGKEEFPLGLNLADLRSFRPTLAKVLEATALKMTSRDQPRPKGPPKSTSPCPGISNSESSPTLNYQGILNRLKQFPR

SEQ ID NO: 793053 - protein, 607 aa, Homo sapiens
GPRWGKEEFPLGLNLADLRSFRPTLAKVLEATALKMTSRDQPRPKGPPKSTSPCPGISNSESSPTLNYQGILNRLKQFPRFSPHFAAELESIYYSLHKIQQDVAEHHKQIGNVLQIVESCSQLQGFQSEEVSPAEPASPGTPQQVKDKTLQESSFEDIMATRSSDWLRRPLGEDNQPETQLFWDKEPWFWHDTLTEQLWRIFAGVHDEKAKPRDRQQAPGLGQESKAPGSCDPGTDPCPEDASTPRPPEASSSPPEGSQDRNTSWGVVQEPPGRASRFLQSISWDPEDFEDAWKRPDALPGQSKRLAVPCKLEKMRILAHGELVLATAISSFTRHVFTCGRRGIKVWSLTGQVAEDRFPESHLPIQTPGAFLRTCLLSSNSRSLLTGGYNLASVSVWDLAAPSLHVKEQLPCAGLNCQALDANLDANLAFASFTSGVVRIWDLRDQSVVRDLKGYPDGVKSIVVKGYNIWTGGPDACLRCWDQRTIMKPLEYQFKSQIMSLSHSPQEDWVLLGMANGQQWLQSTSGSQRHMVGQKDSVILSVKFSPFGQWWASVGMDDFLGVYSMPAGTKVFEVPEMSPVTCCDVSSNNRLVVTGSGEHASVYQITY

SEQ ID NO: 793054 - protein, 601 aa, Homo sapiens
GPRWGKEEFPLGLNLADLRSFRPTLAKVLEATALKMTSRDQPRPKGPPKSTSPCPGISNSESSPTLNYQGILNRLKQFPRFSPHFAAELESIYYSLHKIQQDVAEHHKQIGNVLQIVESCSQLQGFQSEEVSPAEPASPGTPQQVKDKTLQESSFEDIMATRSSDWLRRPLGEDNQPETQLFWDKEPWFWHDTLTEQLWRIFAGVHDEKAKPRDRRAGNKAPGSCDPGTDPCPEDASTPRPPEASSSPPEGSQDRNTSWGVVQEPPGRASRFLQSISWDPEDFEDAWKRPDALPGQSKRLAVPCKLEKMRILAHGELVLATAISSFTRHVFTCGRRGIKVWSLTGQVAEDRFPESHLPIQTPGAFLRTCLLSSNSRSLLTGGYNLASVSVWDLAAPSLHVKEQLPCAGLNCQALDANLDANLAFASFTSGVVRIWDLRDQSVVRDLKGYPDGVKSIVVKGYNIWTGGPDACLRCWDQRTIMKPLEYQFKSQIMSLSHSPQEDWVLLGMANGQQWLQSTSGSQRHMVGQKDSVILSVKFSPFGQWWASVGMDDFLGVYSMPAGTKVFEVPEMSPVTCCDVSSNNRLVVTGSGEHASVYQITY

SEQ ID NO: 793055 - protein, 69 aa, Homo sapiens
LSYFPSSVLSCCLFRSSASRSTSLVVVPSWFCSCRRLPPFAPFLCLSRRSVFVVALFLSRDGLGCLVVG

SEQ ID NO: 793056 - protein, 1590 aa, Homo sapiens
QPLVGVLEGKAHLPGDRLPVVEEEIFLLLPVLRLVLGPLPTLCIVQKDFHLHALPEAEEAHRTAGPGGSRNDSARARERALKVEHGGGERCPGIMVALRGLGSGLQPWCPLDLRLEWVDTVWELDFTETEPLDPSIEAEIIETGLAAFTKLYESLLPFATGEHGSMESIWTFFIENNVSHSTLVALFYHFVQIVHKKNVSVQYREYGLHAAGLYFLLLEVPGSVANQVFHPVMFDKCIQTLKKSWPQESNLNRKRKKEQPKSSQANPGRHRKRGKPPRREDIEMDEIIEEQEDENICFSARDLSQIRNAIFHLLKNFLRLLPKFSLKEKPQCVQNCIEVFVSLTNFEPVLHECHVTQARALNQAKYIPELAYYGLYLLCSPIHGEGDKVISCVFHQMLSVILMLEVGEGSHRAPLAVTSQVINCRNQAVQFISALVDELKESIFPVVRILLQHICAKVVDKSEYRTFAAQSLVQLLSKLPCGEYAMFIAWLYKYSRSSKIPHRVFTLDVVLALLELPEREVDNTLSLEHQKFLKHKFLVQEIMFDRCLDKAPTVRSKALSSFAHCLELTVTSASESILELLINSPTFSVIESHPGTLLRNSSAFSYQRQTSNRSEPSGEINIDSSGETVGSGERCVMAMLRRRIRDEKTNVRKSALQVLVSILKHCDVSGMKEDLWILQDQCRDPAVSVRKQALQSLTELLMAQPRCVQIQKAWLRGVVPVVMDCESTVQEKALEFLDQLLLQNIRHHSHFHSGDDSQVLAWALLTLLTTESQELSRYLNKAFHIWSKKEKFSPTFINNVISHTGTEHSAPAWMLLSKIAGSSPRLDYSRIIQSWEKISSQQNPNSNTLGHILCVIGHIAKHLPKSTRDKVTDAVKCKLNGFQWSLEVISSAVDALQRLCRASAETPAEEQELLTQVCGDVLSTCEHRLSNIVLKENGTGNMDEDLLVIFTLGDIAQLCPARVEKRIFLLIQSVLASSADADHSPSSQGSSEAPASQPPPQVRGSVMPSVIRAHAIITLGKLCLQHEDLAKKSIPALVRELEVCEDVAVRNNVIIVMCDLCIRYTIMVDKYIPNISMCLKDSDPFIRKQTLILLTNLLQEEFVKWKGSLFFRFVSTLIDSHPDIASFGEFCLAHLLLKRNPVMFFQHFIECIFHFNNYEKHEKYNKFPQSEREKRLFSLKGKSNKERRMKIYKFLLEHFTDEQRFNITSKICLSILACFADGILPLDLDASELLSDTFEVLSSKEIKLLAMRSKPDKDLLMEEDDMALANVVMQEAQKKLISQVQKRNFIENIIPIIISLKTVLEKNKIPALRELMHYLREVMQDYRDELKDFFAVDKQLASELEYDMKKYQEQLVQEQELAKHADVAGTAGGAEVAPVAQVALCLETVPVPAGQENPAMSPAVSQPCTPRASAGHVAVSSPTPETGPLQRLLPKARPMSLSTIAILNSVKKAVESKSRHRSRSLGVLPFTLNSGSPEKTCSQVSSYSLEQESNGEIEHVTKRAISTPEKSISDVTFGAGVSYIGTPRTPSSAKEKIEGRSQGNDILCLSLPDKPPPQPQQWNVRSPARNKDTPACSRRSLRKTPLKTAN

SEQ ID NO: 793057 - protein, 1190 aa, Homo sapiens
SRRRLSFNGSHRAPLAVTSQVINCRNQAVQFISALVDELKESIFPVVRILLQHICAKVVDKSEYRTFAAQSLVQLLSKLPCGEYAMFIAWLYKYSRSSKIPHRVFTLDVVLALLELPEREVDNTLSLEHQKFLKHKFLVQEIMFDRCLDKAPTVRSKALSSFAHCLELTVTSASESILELLINSPTFSVIESHPGTLLRNSSAFSYQRQTSNRSEPSGEINIDSSGETVGSGERCVMAMLRRRIRDEKTNVRKSALQVLVSILKHCDVSGMKEDLWILQDQCRDPAVSVRKQALQSLTELLMAQPRCVQIQKAWLRGVVPVVMDCESTVQEKALEFLDQLLLQNIRHHSHFHSGDDSQVLAWALLTLLTTESQELSRYLNKAFHIWSKKEKFSPTFINNVISHTGTEHSAPAWMLLSKIAGSSPRLDYSRIIQSWEKISSQQNPNSNTLGHILCVIGHIAKHLPKSTRDKVTDAVKCKLNGFQWSLEVISSAVDALQRLCRASAETPAEEQELLTQVCGDVLSTCEHRLSNIVLKENGTGNMDEDLLDIFTLGDIAQLCPARVEKRIFLLIQSVLASSADADHSPSSQGSSEAPASQPPPQVRGSVMPSVIRAHAIITLGKLCLQHEDLAKKSIPALVRELEVCEDVAVRNNVIIVMCDLCIRYTIMVDKYIPNISMCLKDSDPFIRKQTLILLTNLLQEEFVKWKGSLFFRFVSTLIDSHPDIASFGEFCLAHLLLKRNPVMFFQHFIECIFHFNNYEKHEKYNKFPQSEREKRLFSLKGKSNKERRMKIYKFLLEHFTDEQRFNITSKICLSILACFADGILPLDLDASELLSDTFEVLSSKEIKLLAMRSKPDKDLLMEEDDMALANVVMQEAQKKLISQVQKRNFIENIIPIIISLKTVLEKNKIPALRELMHYLREVMQDYRDELKDFFAVDKQLASELEYDMKKYQEQLVQEQELAKHADVAGTAGGAEVAPVAQVALCLETVPVPAGQENPAMSPAVSQPCTPRASAGHVAVSSPTPETGPLQRLLPKARPMSLSTIAILNSVKKAVESKSRHRSRSLGVLPFTLNSGSPEKTCSQVSSYSLEQESNGEIEHVTKRAISTPEKSISDVTFGAGVSYIGTPRTPSSAKEKIEGRSQGNDILCLSLPDKPPPQPQQWNVRSPARNKDTPACSRRSLRKTPLKTAN

SEQ ID NO: 793058 - protein, 644 aa, Homo sapiens
MYIFTLGDIAQLCPARVEKRIFLLIQSVLASSADADHSPSSQGSSEAPASQPPPQVRGSVMPSVIRAHAIITLGKLCLQHEDLAKKSIPALVRELEVCEDVAVRNNVIIVMCDLCIRYTIMVDKYIPNISMCLKDSDPFIRKQTLILLTNLLQEEFVKWKGSLFFRFVSTLIDSHPDIASFGEFCLAHLLLKRNPVMFFQHFIECIFHFNNYEKHEKYNKFPQSEREKRLFSLKGKSNKERRMKIYKFLLEHFTDEQRFNITSKICLSILACFADGILPLDLDASELLSDTFEVLSSKEIKLLAMRSKPDKDLLMEEDDMALANVVMQEAQKKLISQVQKRNFIENIIPIIISLKTVLEKNKIPALRELMHYLREVMQDYRDELKDFFAVDKQLASELEYDMKKYQEQLVQEQELAKHADVAGTAGGAEVAPVAQVALCLETVPVPAGQENPAMSPAVSQPCTPRASAGHVAVSSPTPETGPLQRLLPKARPMSLSTIAILNSVKKAVESKSRHRSRSLGVLPFTLNSGSPEKTCSQVSSYSLEQESNGEIEHVTKRAISTPEKSISDVTFGAGVSYIGTPRTPSSAKEKIEGRSQGNDILCLSLPDKPPPQPQQWNVRSPARNKDTPACSRRSLRKTPLKTAN

SEQ ID NO: 793059 - protein, 1126 aa, Homo sapiens
QPLVGVLEGKAHLPGDRLPVVEEEIFLLLPVLRLVLGPLPTLCIVQKDFHLHALPEAEEAHRTAGPGGSRNDSARARERALKVEHGGGERCPGIMVALRGLGSGLQPWCPLDLRLEWVDTVWELDFTETEPLDPSIEAEIIETGLAAFTKLYESLLPFATGEHGSMESIWTFFIENNVSHSTLVALFYHFVQIVHKKNVSVQYREYGLHAAGLYFLLLEVPGSVANQVFHPVMFDKCIQTLKKSWPQESNLNRKRKKEQPKSSQANPGRHRKRGKPPRREDIEMDEIIEEQEDENICFSARDLSQIRNAIFHLLKNFLRLLPKFSLKEKPQCVQNCIEVFVSLTNFEPVLHECHVTQARALNQAKYIPELAYYGLYLLCSPIHGEGDKVISCVFHQMLSVILMLEVGEGSHRAPLAVTSQVINCRNQAVQFISALVDELKESIFPVVRILLQHICAKVVDKSEYRTFAAQSLVQLLSKLPCGEYAMFIAWLYKYSRSSKIPHRVFTLDVVLALLELPEREVDNTLSLEHQKFLKHKFLVQEIMFDRCLDKAPTVRSKALSSFAHCLELTVTSASESILELLINSPTFSVIESHPGTLLRNSSAFSYQRQTSNRSEPSGEINIDSSGETVGSGERCVMAMLRRRIRDEKTNVRKSALQVLVSILKHCDVSGMKEDLWILQDQCRDPAVSVRKQALQSLTELLMAQPRCVQIQKAWLRGVVPVVMDCESTVQEKALEFLDQLLLQNIRHHSHFHSGDDSQVLAWALLTLLTTESQELSRYLNKAFHIWSKKEKFSPTFINNVISHTGTEHSAPAWMLLSKIAGSSPRLDYSRIIQSWEKISSQQNPNSNTLGHILCVIGHIAKHLPKSTRDKVTDAVKCKLNGFQWSLEVISSAVDALQRLCRASAETPAEEQELLTQVCGDVLSTCEHRLSNIVLKENGTGNMDEDLLVIFTLGDIAQLCPARVEKRIFLLIQSVLASSADADHSPSSQGSSEAPASQPPPQVRGSVMPSVIRAHAIITLGKLCLQHEDLAKKSIPALVRELEVCEDVAVRNNVIIVMCDLCIRYTIMVDKYIPNISMCLKDSDPFIRKQTLILLTNLLQEEFVKWKGSLFFRFVSTLIDSHPDIAR

SEQ ID NO: 793060 - protein, 1034 aa, Homo sapiens
QPLVGVLEGKAHLPGDRLPVVEEEIFLLLPVLRLVLGPLPTLCIVQKDFHLHALPEAEEAHRTAGPGGSRNDSARARERALKVEHGGGERCPGIMVALRGLGSGLQPWCPLDLRLEWVDTVWELDFTETEPLDPSIEAEIIETGLAAFTKLYESLLPFATGEHGSMESIWTFFIENNVSHSTLVALFYHFVQIVHKKNVSVQYREYGLHAAGLYFLLLEVPGSVANQVFHPVMFDKCIQTLKKSWPQESNLNRKRKKEQPKSSQANPGRHRKRGKPPRREDIEMDEIIEEQEDENICFSARDLSQIRNAIFHLLKNFLRLLPKFSLKEKPQCVQNCIEVFVSLTNFEPVLHECHVTQARALNQAKYIPELAYYGLYLLCSPIHGEGDKVISCVFHQMLSVILMLEVGEGSHRAPLAVTSQVINCRNQAVQFISALVDELKESIFPVVRILLQHICAKVVDKSEYRTFAAQSLVQLLSKLPCGEYAMFIAWLYKYSRSSKIPHRVFTLDVVLALLELPEREVDNTLSLEHQKFLKHKFLVQEIMFDRCLDKAPTVRSKALSSFAHCLELTVTSASESILELLINSPTFSVIESHPGTLLRNSSAFSYQRQTSNRSEPSGEINIDSSGETVGSGERCVMAMLRRRIRDEKTNVRKSALQVLVSILKHCDVSGMKEDLWILQDQCRDPAVSVRKQALQSLTELLMAQPRCVQIQKAWLRGVVPVVMDCESTVQEKALEFLDQLLLQNIRHHSHFHSGDDSQVLAWALLTLLTTESQELSRYLNKAFHIWSKKEKFSPTFINNVISHTGTEHSAPAWMLLSKIAGSSPRLDYSRIIQSWEKISSQQNPNSNTLGHILCVIGHIAKHLPKSTRDKVTDAVKCKLNGFQWSLEVISSAVDALQRLCRASAETPAEEQELLTQVCGDVLSTCEHRLSNIVLKENGTGNMDEDLLVIFTLGDIAQLCPARVEKRIFLLIQSVLASSADADHSPSSQGSSEAPASQPPPQVRGSVMPSVIRAHAIITLGKKNMGEWGLTSFCV

SEQ ID NO: 793061 - protein, 102 aa, Homo sapiens
QPLVGVLEGKAHLPGDRLPVVEEEIFLLLPVLRLVLGPLPTLCIVQKDFHLHALPEAEEAHRTAGPGGSRNDSARARERALKVEHGGGEPVPWDHGGVAGPW

SEQ ID NO: 793062 - protein, 187 aa, Homo sapiens
RFQSAAGGSRNNQCTEVRPSLAAPYRQMLHTGTDVARNIGSHHVRVEHFMNHSITTLAKDTPLEEVVKVVTSTDVTEYPLVESTESQILVGIVQRAQLVQALQAEPPSRAPGHQVQCLQDILARGCPTEPVTLTLFSETTLHQAQNLFKLLNLQSLFVTSRGRAVGCVSWVEMKKAISNLTNPPAPK

SEQ ID NO: 793063 - protein, 827 aa, Homo sapiens
MLTAPFAGPIDHGSLTVQDDYIFFKATSANQTKYYVSYRRNEFVLMKLPKYALPKDLQIISTDESQVFVAVQEWYQMDTYNLYQSDPRGVRYALVLQDVRSSRQAEESVLIDILEVRGVKGVFLANQKIDGKVMTLITYNKGRDWDYLRPPSMDMNGKPTNCKPPDCHLHLHLRWADNPYVSGTVHTKDTAPGLIMGAGNLGSQLVEYKEEMYITSDCGHTWRQVFEEEHHILYLDHGGVIVAIKDTSIPLKILKFSVDEGLTWSTHNFTSTSVFVDGLLSEPGDETLVMTVFGHISFRSDWELVKVDFRPSFSRQCGEEDYSSWELSNLQGDRCIMGQQRSFRKRKSTSWCIKGRSFTSALTSRVCECRDSDFLCDYGFERSSSSESSTNKCSANFWFNPLSPPDDCALGQTYTSSLGYRKVVSNVCEGGVDMQQSQVQLQCPLTPPRGLQVSIQGEAVAVRPGEDVLFVVRQEQGDVLTTKYQVDLGDGFKAMYVNLTLTGEPIRHRYESPGIYRVSVRAENTAGHDEAVLFVQVNSPLQALYLEVVPVIGLNQEVNLTAVLLPLNPNLTVFYWWIGHSLQPLLSLDNSVTTRFSDTGDVRVTVQAACGNSVLQDSRVLRVLDQFQVMPLQFSKELDAYNPNTPEWREDVGLVVTRLLSKETSVPQELLVTVVKPGLPTLADLYVLLPPPRPTRKRSLSSDKRLAAIQQVLNAQKISFLLRGGVRVLVALRDTGTGAEQLGGGGGYWAVVVLFVIGLFAAGAFILYKFKRKRPGRTVYAQMHNEKEQEMTSPVSHSEDVQGAVQGNHSGVVLSINSREMHSYLVS

SEQ ID NO: 793064 - protein, 1126 aa, Homo sapiens
RPLLLLLLLLGACGAAGRSPEPGRLGPHAQLTRVPRSPPAGRAEPGGGEDRQARGTEPGAPGPSPGPAPGPGEDGAPAAGYRRWERAAPLAGVASRAQVSLISTSFVLKGDATHNQAMVHWTGENSSVILILTKYYHADMGKVLESSLWRSSDFGTSYTKLTLQPGVTTVIDNFYICPTNKRKVILVSSSLSDRDQSLFLSADEGATFQKQPIPFFVETLIFHPKEEDKVLAYTKESKLYVSSDLGKKWTLLQERVTKDHVFWSVSGVDADPDLVHVEAQDLGGDFRYVTCAIHNCSEKMLTAPFAGPIDHGSLTVQDDYIFFKATSANQTKYYVSYRRNEFVLMKLPKYALPKDLQIISTDESQVFVAVQEWYQMDTYNLYQSDPRGVRYALVLQDVRSSRQAEESVLIDILEVRGVKGVFLANQKIDGKVMTLITYNKGRDWDYLRPPSMDMNGKPTNCKPPDCHLHLHLRWADNPYVSGTVHTKDTAPGLIMGAGNLGSQLVEYKEEMYITSDCGHTWRQVFEEEHHILYLDHGGVIVAIKDTSIPLKILKFSVDEGLTWSTHNFTSTSVFVDGLLSEPGDETLVMTVFGHISFRSDWELVKVDFRPSFSRQCGEEDYSSWELSNLQGDRCIMGQQRSFRKRKSTSWCIKGRSFTSALTSRVCECRDSDFLCDYGFERSSSSESSTNKCSANFWFNPLSPPDDCALGQTYTSSLGYRKVVSNVCEGGVDMQQSQVQLQCPLTPPRGLQVSIQGEAVAVRPGEDVLFVVRQEQGDVLTTKYQVDLGDGFKAMYVNLTLTGEPIRHRYESPGIYRVSVRAENTAGHDEAVLFVQVNSPLQALYLEVVPVIGLNQEVNLTAVLLPLNPNLTVFYWWIGHSLQPLLSLDNSVTTRFSDTGDVRVTVQAACGNSVLQDSRVLRVLDQFQVMPLQFSKELDAYNPNTPEWREDVGLVVTRLLSKETSVPQELLVTVVKPGLPTLADLYVLLPPPRPTRKRSLSSDKRLAAIQQVLNAQKISFLLRGGVRVLVALRDTGTGAEQLGGGGGYWAVVVLFVIGLFAAGAFILYKFKRKRPGRTVYAQMHNEKEQEMTSPVSHSEDVQGAVQGNHSGVVLSINSREMHSYLVS

SEQ ID NO: 793065 - protein, 110 aa, Homo sapiens
YTHLNPSSMFTPTPRHAQLNTHTFTDIQSPIHIHTDIHGQPPNTDISHTFTHTQSHMYTHTLAPTPHTFTLTLRHTQLTYTHTHRHTVSHTHIDTDIHGHTTHKHTYTRG

SEQ ID NO: 793066 - protein, 373 aa, Homo sapiens
MLHSITVKSPLCPLPQKSFSLVSKLGKRRSLLLPVQFVLGQQLEVLGAQRVQLQLQLPHTRVVATQPLALQPQPVVLVLHAREALLQFQVLLDELLLAHVLQALRVVPLVRLREVPLQKLAAVPSHPIAAPILLTPFFHEVVIAGVVGFGGGPLGVQAGFEIRLLLVVIIHEELRGVIGRDRLALGEHLGSDPCSSKALFLVELFLLFPGQLVVRFPMPLLLGRASPMFFLPQLSLLLSPLLFAPCGRSPQLTGLGVMTRLGEQLGLGRRFHFCRRREVAASGRVVPILALLALSQAARFWTGLGLQGRWLGFQAPFPLRPRTATQLGERSRLPPTVLLGHPLLRAWGALRVQLFLDSSSTCTVASLRLVLIF

SEQ ID NO: 793067 - protein, 373 aa, Homo sapiens
MLHSITVKSPLCPLPQKSFSLVSKLGKRRSLLLPVQFVLGQQLEVLGAQRVQLQLQLPHTRVVATQPLALQPQPVVLVLHAREALLQFQVLLDELLLAHVLQALRVVPLVRLREVPLQKLAAVPSHPIAAPILLTPFFHEVVIAGVVGFGGGPLGVQAGFEIRLLLVVIIHEELRGVIGRDRLALGEHLGSDPGSSKALFLVELFLLFPGQLVVRFPMPLLLGRASPMFFLPQLSLLLSPLLFAPCGRSPQLTGLGVMTRLGEQLGLGRRFHFCRRREVAASGRVVPILALLALSQAARFWTGLGLQGRWLGFQAPFPLRPRTATQLGERSRLPPTVLLGHPLLRAWGALRVQLFLDSSSTCTVASLRLVLIF

SEQ ID NO: 793068 - protein, 110 aa, Homo sapiens
AFWLGLSHLFQGNQIHFTAAVSGDGCNRLVKAQELGGERESSTLSHWITGYGRDLLAVVLDLFCTMDPFQKLMRANSLPQRAVCIPTVLQMEEGMDCRFSPCQLQSHLTK

SEQ ID NO: 793069 - protein, 84 aa, Homo sapiens
WKVKIANSEVAGSSFTYISFLFSVLWAAMLTASVAKAPWVEMVMRRSTASSWMTGSGYVLDTFSNRGNNCFRTAKSLDFNYKMK

SEQ ID NO: 793070 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 793071 - protein, 186 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRGKRMLLDERWDHLRPSAFLLPLCTQWKRLSWCFLLVCIVG

SEQ ID NO: 793072 - protein, 135 aa, Homo sapiens
DVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASY

SEQ ID NO: 793073 - protein, 71 aa, Homo sapiens
GGPRAERAAGIASSEGTQAMEEMWLCFCSLQKRVLEEGQQLPRVLGRQQKRVDISRARAMMKGHEIRHFGD

SEQ ID NO: 793074 - protein, 70 aa, Homo sapiens
GGGGPEGFASSLLRPAGEKVRFGSSAGGQEAQVVRDAGPGASVSVLRAQSLQASSRPRAQHSLSYGPEAL

SEQ ID NO: 793075 - protein, 56 aa, Homo sapiens
MTELVAELEPLKLLQANFLEQPKKVRAPPFRHIQLEFWNKAHERDSTHRGPLDRRR

SEQ ID NO: 793076 - protein, 71 aa, Homo sapiens
MTFGSSETAEDGQSHAEVSRTVLKIRLTKRQRRRLVDNQMCKIGKSRCNQFTYQERVITITKGKISPSQMV

SEQ ID NO: 793077 - protein, 127 aa, Homo sapiens
YLKGVMEPIIGTAGRLLYILIVHQSPELHLADVLPLPHLFERAFDDYMDSCLFYFLRWSFALVCQAGMQWCYIGLLQPPPPGFKPFSSLSLPLAGITGTRHHAQLIFVFLVETGFPHVGQAGLKLLT

SEQ ID NO: 793078 - protein, 82 aa, Homo sapiens
RAVLWQICERTAYEEREATSHTSQLRSPETALQAHKPLSQAICQEPHEEHSTAPASEAHGFAYHMSCFLLIRGSQAQCDPTS

SEQ ID NO: 793079 - protein, 81 aa, Homo sapiens
MPAIFAKCCIQEILSECVSLLLFLGSYVRLFTLGICPELKSLSPFPQGETKIEFSYLSCLILFREKILHLLNFILGLKLFF

SEQ ID NO: 793080 - protein, 210 aa, Homo sapiens
NRFTTLTKHKRIHAGEKPITCEECRKIFTSSSNFAKHKRIHTGEKPYKCEECGKAFNRSTTLTKHKRIHTGEKPYTCEECGKAFRQSSKLNEHKKVHTGERPYKCDECGKAFGRSRVLNEHKKIHTGEKPYKCEECGKAFRRSTDRSQHKKIHSADKPYKCKECDKAFKQFSLLSQHKKIHTVDKPYKCKDCDKAFKRFSHLNKHKKIHT

SEQ ID NO: 793081 - protein, 126 aa, Homo sapiens
MRKCRIRQSTMRKSAKLPPKNYLPQQLQSRNANKPVSLGVGHTQLWTTHNIFSLYFASESVYCNDFSFACFICLKLSSLKAELKINVCYQKGVAVPGHVGICPTLSVQRVSSLFLFKKFIMMIYKN

SEQ ID NO: 793082 - protein, 110 aa, Homo sapiens
LTWEAGDKSGISRFLSALLLAVCPSPLDPNQQDLHHLELGKKADFYHLKLGVGPAACLSAVLMHAGVWRAPALSPPCPFTQPCAFIPPPVALGSGHCAVGVHLAHSLFFF

SEQ ID NO: 793083 - protein, 68 aa, Homo sapiens
GKVTTRAACLVNYPENKNIQRLLGLGPPPINYGQAVEQSPGETGCWRVPPPNPTSDQEASGSGKGLPG

SEQ ID NO: 793084 - protein, 112 aa, Homo sapiens
FWAVLGAGIVPYPLLHSFPKSSHLRPSLGEKIPVPRHLCTLLYDWACFRNILQRRRRRRRNGLESCLHLVLLIRSHLERLFITPSITLCLEALVALTDRLMSRKYCSMSNGT

SEQ ID NO: 793085 - protein, 68 aa, Homo sapiens
RNTLTQLHPSVINAVAEESEGLQEPRRNTRPSPVLPPAHSPPAAVNSTMAVAHTCSSSTLRGQGARIA

SEQ ID NO: 793086 - protein, 79 aa, Homo sapiens
PSSATARASRSCSSISEQFTDMFQHKAFLHWYMGKGMDEMEFTEAESNMNDLVSEYQQYQDATAEEEGEFEEEAEEEVA

SEQ ID NO: 793087 - protein, 148 aa, Homo sapiens
MTQKGSMKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFS

SEQ ID NO: 793088 - protein, 148 aa, Homo sapiens; identical to SEQ ID NO: 793087

SEQ ID NO: 793089 - protein, 119 aa, Homo sapiens
GRGTRKRAWTWRTEAGRAEGRLGRRGEAGAPPGPRRAVVTGGRLRRGSGRAEPGSRRLLPSRPGLRVAEIGRRVCASGEADPSPLRLFGCSCTSGQRAGANHDTEGQYEACEEKENRRT

SEQ ID NO: 793090 - protein, 128 aa, Homo sapiens
VCLLSGSLSPQPAMEEQPQMQDADEPADSGGEGRAGGPPQVAGAQAACSEDRMTLLLRLRAQTKQQLLEYKSMVDASEEKTPEQIMQEKQIEAKIEDLENEIEEVKVAFEIKKLALDRMRLSTALQPG

SEQ ID NO: 793091 - protein, 311 aa, Homo sapiens
VCLLSGSLSPQPAMEEQPQMQDADEPADSGGEGRAGGPPQVAGAQAACSEDRMTLLLRLRAQTKQQLLEYKSMVDASEEKTPEQIMQEKQIEAKIEDLENEIEEVKVAFEIKKLALDRMRLSTALKKNLEKISRQSSVLMDNMKHLLELNKLIMKSQQESWDLEEKLLDIRKKRLQLKQASESKLLEIQTEQEQTERLIGTVWKTQERHTKIHTTKAYRMEIQNYYLLFTHVFPEPYFRGSNSPIGAEDPALKEHWFCKFEKNVDLIVYKIPFLTYFTFSGNLNSYLEYFCALSVHRNFESYHNGYRVVQW

SEQ ID NO: 793092 - protein, 93 aa, Homo sapiens
VCLLSGSLSPQPAMEEQPQMQDADEPADSGGEGRAGGPPQVAGAQAACSEDRMTLLLRLRAQTKQQLLEYKSMVDASEEKTPEQIMQEKQIEA

SEQ ID NO: 793093 - protein, 135 aa, Homo sapiens [sequence omitted]

SEQ ID NO: 793094 - protein, 98 aa, Homo sapiens
FLAVTTYPQENMPLAKDLLHPSPEEEKKKHKKKRLVQSPNSYFMGVKCPGYYKSPRSLAMHKGSFVCWLLHCPLPAYRRKSKAYRRMFLQEEAALKAL

SEQ ID NO: 793095 - protein, 167 aa, Homo sapiens
QDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLVSGGAFTLVAAFDLVSH

SEQ ID NO: 793096 - protein, 127 aa, Homo sapiens
HCERSPDFWFLCRCFFCVLTLVLVGRVAEWGHTISGAFHLAILLHTIPLSSYLQLLQRHFIACPIGFSWLRRAHKALSDLASPDLLRVISHHLSSALAIIPNDPLFLSGGTFPLIQGPEHMLCFTWL

SEQ ID NO: 793097 - protein, 105 aa, Homo sapiens
MLSPKWLSDLPKLYNALLNSDVFISCARLLKKIKINKKRKYISKKRKTRKRKKRSTFVFVQSVGSQENVPSLFVGMGTVGSGAFRSTLSFIWTVSLTSMNNYFSP

SEQ ID NO: 793098 - protein, 172 aa, Homo sapiens
IYRVKVKGWKKIFHTDGNQKQIGVAILISDKTDIKSTIVKKRQRRSLYYHKRINCRRKMSFLNIYASNTTAPRFIKQIQLDLRKEKDSNAIIVGDFSTLLTALDRSLRQKINKETLGLNWTLDQMDLTDIYRTFYHTPVEYSFFSSAHGTFLNDHMQGHKASLKKILKIEIM

SEQ ID NO: 793099 - protein, 120 aa, Homo sapiens
MGKPWLLTGLQVVFSILHLHVLCISDSLDWMHGHAGTEKSHSTVYSPFSNKVTPFPSHRLPPSPQPTYDIHSSPVLPSHPQKLGPLLICQKGNCLKKKKIPNRNRWESCPEMSEHLTVDT

SEQ ID NO: 793100 - protein, 73 aa, Homo sapiens
QPRQRQNRSGSGGGGSTSSGSERNASAARGPPRSFPAPALLCRSLLSRHPPPSPPPAHSLFPSLSPPPRLLPD

SEQ ID NO: 793101 - protein, 136 aa, Homo sapiens
QPRQRQNRSGSGGGGSTSSGSERNASAARGPPRSFPAPALLCRSLLSRHPPPSPPPAHSLFPSLSPPPRLLPDSPTALALSHSLCLSSPVPSSRSFTRPSPFSTLFIDYMLLSHPTFRRRRYSQAPCRLVGGDPQS

SEQ ID NO: 793102 - protein, 79 aa, Homo sapiens
GSGGATEETQGSKERGHHSRGSIQRPEWGPALPPTLASHPLPNPNSSSPASRALSSISNNNDTYRIAWTYPTSSDPVSA

SEQ ID NO: 793103 - protein, 348 aa, Homo sapiens
MPRSFLVKKVKLDAFSSADLESAYGRARSDLGAPLHDKGYLSDYVGPSSVYDGDAEAALLKGPSPEPMYAAAVRGELGPAAAGSAPPPTPRPELATAAGGYINGDAAVSEGYAADAFFITDGRSRRKASNAGSAAAPSTASAAAPDGDAGGGGGAGGRSLGSGPGGRGGTRAGAGTEARAGPGAAGAGGRHACGECGKTYATSSNLSRHKQTHRSLDSQLARRCPTCGKVYVSMPAMAMHLLTHDLRHKCGVCGKAFSRPWLLQGHMRSHTGEKPFGCAHCGKAFADRSNLRAHMQTHSAFKHFQCKRCKKSFALKSYLNKHYESACFKGGAGGPAAPAPPQLSPVQA

SEQ ID NO: 793104 - protein, 83 aa, Homo sapiens
VPDKAKGDWEPGVDLLPQKQEGSPTLPLKHSPLSKYKQASASTASLTREQRGRVLTILPGSFVDPQCYHLKSVKPSREPFTFH

SEQ ID NO: 793105 - protein, 1142 aa, Homo sapiens
MLVLRCRLGTSFPKLDNLVPKGKMKILLVFLGLLGNSVAMPMHMPRMPGFSSKSEEMMRYNQFNFMNGPHMAHLGPFFGNGLPQQFPQYQMPMWPQPPPNTWHPRKSSAPKRHNKTDQTQETQKPNQTQSKKPPQKRPLKQPSHNQPQPEEEAQPPQAFPPFGNGLFPYQQPPWQIPQRLPPPGYGRPPISNEEGGNPYFGYFGYHGFGGRPPYYSEEMFEQDFEKPKEEDPPKAESPGTEPTANSTVTETNSTQPNPKGSQGGNDTSPTGNSTPGLNTGNNPSARNGIGPLPAVNASGQGGPGSQIPWRPSQPNIRENHPYPNIRNFPSGRQWYFTGTVMGHRQNRPFYRNQQVQRGPRWNFFAWERKQVARPGNPVYHKAYPPTSRGNYPNYAGNPANLRRKPQGPNKHPVGTTVAPLGPKPGPVVRNEKIQNPKEKPLGPKEQIIVPTKNPTSPWRNSQQYEVNKSNYKLPHSEGYMPVPNFNSVDQHENSYYPRGDSRKVPNSDGQTQSQNLPKGIVLGSRRMPYESETNQSELKHSSYQPAVYPEEIPSPAKEHFPAGRNTWDHQEISPPFKEDPGRQEEHLPHPSHGSRGSVFYPEYNPYDPRENSPYLRGNTWDERDDSPNTMGQKESPLYPINTPDQKEIVPYNEEDPVDPTGDEVFPGQNRWGEELSFKGGPTVRHYEGEQYTSNQPKEYLPYSLDNPSKPREDFYYSEFYPWSPDENFPSYNTASTMPPPIESRGYYVNNAAGPEESTLFPSRNSWDHRIQAQGQRERRPYFNRNIWDQATHLQKAPARPPDQKGNQPYYSNTPAGLQKNPIWHEGENLNYGMQITRMNSPEREHSSFPNFIPPSYPSGQKEAHLFHLSQRGSCCAGSSTGPKDNPLALQDYTPSYGLAPGENQDTSPLYTDGSHTKQTRDIISPTSILPGQRNSSEKRESQNPFRDGVSTLRRNTPCSIKNQLGQKEIMPFPEASSLQSKNTPCLKNDLGGDGNNILEQVFEDNQLNERTVDLTPEQLVIGTPDEGSNPEGIQSQVQENESERQQQRPSNILHLPCFGSKLAKHHSSTTGTPSSDGRQSPFDGDSITPTENPNTLVELATEEQFKSINVDPLDADEHSPFEFLQRGTNVQDQVQDCLLLQA

SEQ ID NO: 793106 - protein, 45 aa, Homo sapiens
MACAVKVGRADLASYLSLLKFPKKPVVDSGSQEVWACWNLLNLQL

SEQ ID NO: 793107 - protein, 110 aa, Homo sapiens
SCSHQPWLQPDPPRPLQKLQLSDHSPCRRKISLTKKAWSTQASMALGDRPGQHRSPAQRGEHSAGYRHRPLCNVRGGSLREPLVREMEEENLPAFGPSLAANEKPDSVTH

SEQ ID NO: 793108 - protein, 109 aa, Homo sapiens
SSEQDSMGMGCAKPGMGGYLLVYRLLRPWEKSSIWSGVYRFSRYSLSWPPLARKEKSPNPLCFPGEATPCPASSCPPWAAPTVQAVPMRRTRYLSWKCRNHPSSVPILL

SEQ ID NO: 793109 - protein, 121 aa, Homo sapiens
SELVSCWEGSPQIGVISAPPVDRVSLPTGTCDPAVSSTSFQLLKPEAALRTHSQGPFTNLRQRLETGRGCNSQGRGPGLLPPWRSGLEPQVTLGLPGVRRAPWCVCFFGSPTFLSSAILQF

SEQ ID NO: 793110 - protein, 150 aa, Homo sapiens
CPSPSRRTAFLLPCSFRQLKSHGSLPLAQIGSRAGPSGSHWLEGGDAMIGQAWSRVLSQPGARSALSEEPGLRRGGCYPSRCRGSRGSHLLLRGTSSTALGWGGRAEVVSKPPYSTGRETEAQRQTVPTQSPSRVISAHLPKGWMGSVSG

SEQ ID NO: 793111 - protein, 131 aa, Homo sapiens
QRSALSRPWCPSGVTGPFHPRLLLSKLPSAQPARSLDHGSTPCLEPPAGPPTHTQPQAPECGSQTPEGAPLPDPVSSPAPSYTSVIPTTETTSHSTPSFTSSITTTETTSHSTPSFTSSITTTETTSHSTP

SEQ ID NO: 793112 - protein, 121 aa, Homo sapiens
QRSALSRPWCPSGVTGPFHPRLLLSKLPSAQPARSLDHGSTPCLEPPAGPPTHTQPQAPECGSQTPEGAPLPDPVSSPAPSPPPASFSAHELAPRSERPPPSSGCPLCACPSGNSCLPCKT

SEQ ID NO: 793113 - protein, 110 aa, Homo sapiens [sequence omitted]

SEQ ID NO: 793114 - protein, 180 aa, Homo sapiens
TLKNLLSCVYSCPSYIAKDLMKVLQGVNGEMVLSQLLPMAEQLLEKIQKEPTAVLKDEAMVLHLTLGKYNEFSVSLLNEDPKSLDIFIKAVHTTKELYAGMPTIQITALEKITKPFFAAISDEKVQQKLLRMLFDLLVNCKNSHCAQTVSSVFKGISVNAEQVRIELEPPDKAKPLGTVQ

SEQ ID NO: 793115 - protein, 91 aa, Homo sapiens
REKDTVSTEHVHVAASGQPGCSSTPRVVGDKPSWGWMWMGLKTNQRMLLCRQWRATDDNVENLKKNGDRESKERSRCGGVHNSHVKNQLQL

SEQ ID NO: 793116 - protein, 857 aa, Homo sapiens
QGVSRVPESAGGGAGGRALGRVTGRSPPSTVEAGAPARCSRCARATPRSKPRVALPGPFFPRVGAASQPPPRPRLALPSGSFGLSLAVRQALASSHQARRGARPWVSGQAASVRAAPALRTRLFIGLRISWLLLASAALLEAALRNLNMDQKLSKLVEELTTSGEPRLNPEKMKELKKICKSSEEQLSRAYRLLIAQLTQEHAEIRLSAFQIVEELFVRSHQFRMLVVSNFQEFLELTLGTDPAQPLPPPREAAQRLRQATTRAVEGWNEKFGEAYKKLALGYHFLRHNKKVDFQDTNARSLAERKREEEKQKHLDKIYQERASQAEREMQEMSGEIESCLTEVESCFRLLVPFDFDPNPETESLGMASGMSDALRSSCAGQVGPCRSGTPEPRDGEQTCCSRDLPASAGHPRAGGGAQPSQTATGDPSDEDEDSDLEEFVRSHGLGSHKYTLDVELCSEGLKVQENEDNLALIHAARDTLKLIRNKFLPAVCSWIQRFTRVATHGGCLKRAIDLKAELELVLRKYKELDIEPEGGERRRTEALGDAEEDEDDEDFVEVPEKEGYEPHIPDHLRPEYGLEAAPEKDTVVRCLRTRTRMDEEVSDPTSAAAQLRQLRDHLPPPSSASPSRALPEPQEAQKLAAERARAPVVPYGVDLHYWGQELPTAGKIVKSDSQHRFWKPSEVEEEVVNADISEMLRSRHITFAGKFEPVQHWCRAPRPDGRLCERQDRLKCPFHGKIVPRDDEGRPLDPEDRAREQRRQLQKQERLEWQDPELMRDVEAATGQDLGSSRYSGKGRGKKRRYPSLTNLKAQADTARARIGRKVFAKAAVRRVVAAMNRMDQKKHEKFSNQFNYALN

SEQ ID NO: 793117 - protein, 113 aa, Homo sapiens
QGVSRVPESAGGGAGGRALGRVTGRSPPSTVEAGAPARCSRCARATPRSKPRVALPGPFFPRVGRSFPASAPASPGASFRVLRPFPGGAAGPRLIPPGTPRCSALGIRAGCLR

SEQ ID NO: 793118 - protein, 341 aa, Homo sapiens
QGVSRVPESAGGGAGGRALGRVTGRSPPSTVEAGAPARCSRCARATPRSKPRVALPGPFFPRVGAASQPPPRPRLALPSGSFGLSLAVRQALASSHQARRGARPWVSGQAASVRAAPALRTRLFIGLRISWLLLASAALLEAALRNLNMDQKLSKLVEELTTSGEPRLNPEKMKELKKICKSSEEQLSRAYRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDTDNLELDEEGAGGFTAKAIVQRDRVDEDA

SEQ ID NO: 793119 - protein, 130 aa, Homo sapiens
APVRSPGLCGRRAETCGQGVSRVPESAGGGAGGRALGRVTGRSPPSTVEAGAPARCSRCARATPRSKPRVALPGPFFPRVGRSFPASAPASPGASFRVLRPFPGGAAGPRLIPPGTPRCSALGIRAGCLR

SEQ ID NO: 793120 - protein, 92 aa, Homo sapiens
KAKRATALVCPNLWEWDAPSTRMACIFTMTFSSGDRQPHHLNRLPLSPKNPQALGKTIPPKHPSVPRRFIPALQAPPNHLDQPPHQRATSSK

SEQ ID NO: 793121 - protein, 105 aa, Homo sapiens
MGARSQPRTAGAVAGGGSGGNSCVSELSGHCHPVMPSDGFKQQRSTKEAGGRGGLPVRAPPWERAGCESLGSSHSPHPMRKLRPALSPSPVPFPGACVRAATGHL

SEQ ID NO: 793122 - protein, 66 aa, Homo sapiens
VKGIKGRLNRLPAAGVGDMGMATVKKGKLELRKKCSGTLVKGTPLENTEGGMSGGSASPWLPTMNA

SEQ ID NO: 793123 - protein, 77 aa, Homo sapiens
RFDYAARSDYAARSDYAARSDYAARSDYAARSDYAARSDLRDSIMFQSHWFYLLLYCSSDLFQVIIKIPTKLQVSKF

SEQ ID NO: 793124 - protein, 102 aa, Homo sapiens
GPLELCGSPSSCSVHRSSCSPQLPSALQPHSQPLADLLTMTSKHPESSRLSPPSLPLFPKGCCPWVCLLEPPRRREDFKDRKRARHQTSSRPCFPRLSNLKK

SEQ ID NO: 793125 - protein, 75 aa, Homo sapiens
HESASNDCRLILSNHSVILETITVLLIEFCLLKIVRDCIYPVRDCRITVFFGTERNVSFCKASLSNDMAVLNVLL

SEQ ID NO: 793126 - protein, 107 aa, Homo sapiens
NHSSLQPHTTGFKKFSQLITLPNSWKNRHVPPHQFFNSNYLTSPRKQTSPNMYICYSHPLLCKLHLPCHDSAPPVRHYSSYSLHNYLLSIYLVPGNPLGTEAITDNK

SEQ ID NO: 793127 - protein, 120 aa, Homo sapiens
HHFHRGTTSPGMHPYRIYPAAFPELSHLPQVPKPTFTILGPVLGFLLWKAIPSFASSTLRMSSSLHSLWFVPLVSEEEVLIILSGSECSTCPYVLSYPTSSLTLFHQFLSFSPCCVFPST

SEQ ID NO: 793128 - protein, 165 aa, Homo sapiens
TPVTPLQAPTTLMVTEGDSQHPSVPVRALVLTAPWSMPHAPTLGLAPGPDGTWPLESAGGPQSWWSHSLPSWVSTSCLDRTLWPVRALASPAAAPPILIPHPIPCQHPKAPGGHPLCSKLLTCLPATPAVPSQPGHHHPLFIMSGLMGAWPSPEAGPGVLPSWTT

SEQ ID NO: 793129 - protein, 165 aa, Homo sapiens; identical to SEQ ID NO: 793128

SEQ ID NO: 793130 - protein, 167 aa, Homo sapiens
TPVTPLQAPTTLMVTEGDSQHPSVPVRALVLTAPWSMPHAPTLGLAPGPDGTWPLESAGGPQSWWSHSLPSWVSTSCLDRTLWPVRALASPAAAPPILIPHPIPCQHPKAPGGHPLCSKLLTCLPATPAVPSQPGHHHPLFIMSGLMGAWPSPEAGPGVLPSWTTAE

SEQ ID NO: 793131 - protein, 310 aa, Homo sapiens
ALVGPAGPGPPRAESQEGVREGEGWRGAWPGRGEVCKRLTPMSQQVRHVSTLLPALLGALGEGDARLVGAALGALRRLLLRPRAPVRLLSAELGPRLPPLLDDTRDSIRASAVGLLGTLVRRGRGGLRLGLRGPLRKLVLQSLVPLLLRLHDPSRDAAEVQRYPGHVPNFLSQTQGYLRSPQDPLRRAATVLIGFLVHHASPGCVNQDLLDSLFQDLGRLQSDPKPAVAAAAHVSAQQVAMLARARGCRRGPAFSASPRAPPGPHQSSPTAPSSAGASRAAGAAPDPAEPEARAGAEGQGPTRAPHAHSS

SEQ ID NO: 793132 - protein, 282 aa, Homo sapiens
DHTESAAFPRPAASSLRAGRPLPPLQPLSVSACPDCALPTQTRDSIRASAVGLLGTLVRRGRGGLRLGLRGPLRKLVLQSLVPLLLRLHDPSRDAAEVQRYPGHVPNFLSQTQGYLRSPQDPLRRAATVLIGEAARGHTAPGTGALGAGPASPWGAVGPALMHLLWSRLPCPPRQPRLCQPGPAGLPVPGPRAAAERPQAGRGRGSARVRSAGGDAGPCPGLPPRPRLLRIAPRPARPPPVFADSPFQRRSVAGRWGCSGPRRARGSGWGRGPGSDSGTPRA

SEQ ID NO: 793133 - protein, 215 aa, Homo sapiens
ALVGPAGPGPPRAESQEGVREGEGWRGAWPGRGEVCKRLTPMSQQVRHVSTLLPALLGALGEGDARLVGAALGALRRLLLRPRAPVRLLSAELGPRLPPLLDDTRDSIRASAVGLLGTLVRRGRGGLRLGLRGPLRKLVLQSLVPLLLRLHDPSRDAAEVQRYPGHVPNFLSQTQGYLRSPQDPLRRAATVLIGLNEERATGHMRKRLPWELLML

SEQ ID NO: 793134 - protein, 222 aa, Homo sapiens
ALVGPAGPGPPRAESQEGVREGEGWRGAWPGRGEVCKRLTPMSQQVRHVSTLLPALLGALGEGDARLVGAALGALRRLLLRPRAPVRLLSAELGPRLPPLLDDTRDSIRASAVGLLGTLVRRGRGGLRLGLRGPLRKLVLQSLVPLLLRLHDPSRDAAEVSSPHTIPPLCHPTLTTPTVPPLRQLQSSEWTLARCDHAFCWGLLEELVTVAHYDSPEALSHL

SEQ ID NO: 793135 - protein, 118 aa, Homo sapiens
KEQVRELALVGFGGTQSTRPGLGLGGNETCGGSGLKMWQRPEPGERLNPFGQGEGERGKGLVLLFKQEEDYKPPSTICQALEFEPPSSGVTQMQRKPGLLLTFLRGGKSINGDPHMYK

SEQ ID NO: 793136 - protein, 362 aa, Homo sapiens
MDLHMMNCELLATCSALGYLEGDTYHKEPDCLESVKDLIRYLRHEDETRDVRQQLGAAQILQSDLLPILTQHHQDKPLFDAVIRLMVNLTQPALLCFGNLPKEPSFRHHFLQVLTYLQAYKEAFASEKAFGVLSETLYELLQLGWEERQEEDNLLIERILLLVRNILHVPADLDQEKKIDDDASAHDQLLWAIHLSGLDDLLLFLASSSAEEQWSLHVLEIVSLMFRDQNPEQLAGVGQGRLAQERSADFAELEVLRQREMAEKKTRALQRGNRHSRFGGSYIVQGLKSIGERDLIFHKGLHNLRNYSSDLGKQPKKVPKRRQAARELSIQRRSALNVRLFLRDFCSEFLENCYNRLMGSVK

SEQ ID NO: 793137 - protein, 109 aa, Homo sapiens
ESLKLFDSICNNKWFTDTSIILFLNKKDIFEEKIKKSPLTICFPEYTGPSAFTEAVAYIQAQYESKNKSAHKEIYTHVTCATDTNNIQFVFDAVTDVIIAKNLRGCGLY

SEQ ID NO: 793138 - protein, 157 aa, Homo sapiens
MVKTGTGQWRRSFCLWSVMRGTQGSFLLCGERGAQSRTEPRGCQGEAARPGPWNQPPKALEPACSMQLRLFQSVSYSVPFQQTPPCFALISLHFLLLLSGKILCALTDSRVFLLEVDFLVTVRYPNIGECKAFFFQLFILMNYIQEISRKLNSLKDY

SEQ ID NO: 793139 - protein, 80 aa, Homo sapiens
PLMPGACGAAAAPSVGPRACAHPELMLPASPMRSPVPTCASPSTPLCQPRELLRPRPTQRGAPTVQRLAKGLLKRGQSGR

SEQ ID NO: 793140 - protein, 315 aa, Homo sapiens
MHREPAKKKAEKRLFDASSFGKDLLAGGVAAAVSKTAVAPIERVKLLLQVQASSKQISPEARYKGMVDCLVRIPREQGFFSFWRGNLANVIRYFPTQALNFAFKDKYKQLFMSGVNKEKQFWRWFLANLASGGAAGATSLCVVYPLDFARTRLGVDIGKGPEERQFKGLGDCIMKIAKSDGIAGLYQGFGVSVQGIIVYRASYFGAYDTVKGLLPKPKKTPFLVSFFIAQVVTTCSGILSYPFDTVRRRMMMQSGEAKRQYKGTLDCFVKIYQHEGISSFFRGAFSNVLRGTGGALVLVLYDKIKEFFHIDIGGR

SEQ ID NO: 793141 - protein, 134 aa, Homo sapiens
MHREPAKKKAEKRLFDASSFGKDLLAGGVAAAVSKTAVAPIERVKLLLQVQASSKQISPEARYKGMVDCLVRIPREQGFFSFWRGNLANVIRYFPTQALNFAFKDKYKQLFMSGVNKEKQLQPDGVLSMENYLF

SEQ ID NO: 793142 - protein, 204 aa, Homo sapiens
MSGVNKEKQFWRWFLANLASGGAAGATSLCVVYPLDFARTRLGVDIGKGPEERQFKGLGDCIMKIAKSDGIAGLYQGFGVSVQGIIVYRASYFGAYDTVKGLLPKPKKTPFLVSFFIAQVVTTCSGILSYPFDTVRRRMMMQSGEAKRQYKGTLDCFVKIYQHEGISSFFRGAFSNVLRGTGGALVLVLYDKIKEFFHIDIGGR

SEQ ID NO: 793143 - protein, 66 aa, Homo sapiens
SLFFPDKNLNSKKRTGIILPNPTSHEPMQEAQNHLLSGHVAADSISEVLAAYDFTDEDGSHLSRDS

SEQ ID NO: 793144 - protein, 106 aa, Homo sapiens
QHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNVSVP

SEQ ID NO: 793145 - protein, 232 aa, Homo sapiens
QHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQDTENELKKLQQTQEYFIIQYQESLRIQAQFGPLAQLSPQERLSRETALQQKQVSLEAWLQREAQTLQQYRVELAEKHQKTLQLLRKQQTIILDDELIQW

SEQ ID NO: 793146 - protein, 79 aa, Homo sapiens
QSIEQTSINPQKTLSRRTLSLLETQKLRGAAGDHGVKKVGGLSTAVCTQPGTRVKTTGLVLKNPSLVKQPVGVCGRRKN

SEQ ID NO: 793147 - protein, 247 aa, Homo sapiens
GQVLVQLLWALKGASRPEPQALAATRALGEMLAVSGCVGATRGFYPHLLLALVTQLHKLARSPCSPDMPKIWVLSHRGPPHSHASCAVEALKALLTGDGGRMVVTCMEQAGGWRRLVGAHTHLEGVLLLARAVAEPPTARLLREEVILERLLTWQGDPEPTVRWLGLLGLGHLALNRRKVRHVSTLLPALLGALGEGDARLVGAALGALRRLLLRPRAPVRLLSAELGPRLPPLLDDTRDSIRASAV

SEQ ID NO: 793148 - protein, 111 aa, Homo sapiens
SYPCSPGGEPDRSKHVRPALKGQLQSVLSGALSLFFPTQPCAMLMLHEIPASSSFVTRAHDALSDDTSDPRRIHAVETNNSLFALMTCHLIDTSLDGWSTGIWATREFRLG

SEQ ID NO: 793149 - protein, 214 aa, Homo sapiens
RSACGAAAATDVHKGLERSVERVRGQAMNLGDGLKLETELLDGKTKLILSPYEHKSKISVKMGNKAKIAKCPLRTKTGHILKSTQDTCIGSEKLLQKKPVGSETSQAKGEKNGMTFSSTKDLCKQCIDKDCLHIQKEISPATPNMQKTRNTVNTSLVGKQKPHKKHITAENMKSSLVCLTQDQLQQILMTVNQGNRSLSLTENGKEAKSQYSLY

SEQ ID NO: 793150 - protein, 153 aa, Homo sapiens
MGNKAKIAKCPLRTKTGHILKSTQDTCIGSEKLLQKKPVGSETSQAKGEKNGMTFSSTKDLCKQCIDKDCLHIQKEISPATPNMQKTRNTVNTSLVGKQKPHKKHITAENMKSSLVCLTQDQLQQILMTVNQGNRSLSLTENGKEAKSQYSLY

SEQ ID NO: 793151 - protein, 153 aa, Homo sapiens; identical to SEQ ID NO: 793150

SEQ ID NO: 793152 - protein, 153 aa, Homo sapiens; identical to SEQ ID NO: 793150

SEQ ID NO: 793153 - protein, 153 aa, Homo sapiens; identical to SEQ ID NO: 793150

SEQ ID NO: 793154 - protein, 203 aa, Homo sapiens
LQDGMVPCRESELATCGRIIVLNQDIKYWNAKGVMWFDYIYYIVGSELRNMGNKAKIAKCPLRTKTGHILKSTQDTCIGSEKLLQKKPVGSETSQAKGEKNGMTFSSTKDLCKQCIDKDCLHIQKEISPATPNMQKTRNTVNTSLVGKQKPHKKHITAENMKSSLVCLTQDQLQQILMTVNQGNRSLSLTENGKEAKSQYSLY

SEQ ID NO: 793155 - protein, 153 aa, Homo sapiens; identical to SEQ ID NO: 793150

SEQ ID NO: 793156 - protein, 111 aa, Homo sapiens
YFLFLRRSLTLLPRLECSGAISTRRNLHLTDSSNSPASASRVAGITGARHHARLIFVFLVETGFHHFGQAGLKLLTSGEPPAFGLPKCWDYRHEPPPRPATKIFSLHKDTS

SEQ ID NO: 793157 - protein, 32 aa, Homo sapiens
KGTVRGTVYSERSTSAALSCVVSTRTVLVRLF

SEQ ID NO: 793158 - protein, 68 aa, Homo sapiens
DPRSRERLDTQWVGRGISGGSRSASYLGKTTGNCTVDYSKIDSVHLWGKWADEEVHLGKGKRSDSNWS

SEQ ID NO: 793159 - protein, 132 aa, Homo sapiens
KEGPVLKYQKRVALYIAAFCGYIELTEWALKQGARPHEAVGVHPYRAWCHEALHADVSKCPIHAAAEAGQLLILKAFVNYSVLCLECKNAAGQTPLTIVFKHKHKDCVLYLLSKMWSTVSFPKISVTNEDLY

SEQ ID NO: 793160 - protein, 101 aa, Homo sapiens
DLTRTFTAALFITIKPAGLFTIAKIWNQPNCPSVDEWIKKMWYIYTMEYYSALMRKEILSFVITWMNLEDRTQMFVNRIEFLNCGIFRLWTITQQLKSINY

SEQ ID NO: 793161 - protein, 107 aa, Homo sapiens
SQPPPHFAPPHFAPPSSRSPHPSPGLPSPAGTEMKAALPALSILMGRCQAHSQTLGNLGQGNEAAGQGRARPVLSLGECLTAPDQGHHLASLPPPSPIPLSCPPSRP

SEQ ID NO: 793162 - protein, 123 aa, Homo sapiens
NSIKEVHNLNTKNYKTSLEEIKHLNMWKDILCSSIRRINIVKTAIVPILVYRFNPIPIKILTAFFFFFFFCRNGKSDPKIHTELQEASDCQNYPIKELNWKTYTSQFQKLLQNCSNQDSMVLA

SEQ ID NO: 793163 - protein, 106 aa, Homo sapiens
VGGDGVQGGGSWAWGLVLEASGLEGLRQLRGRVVYQASVREVSPHLPVTGRGLKKQPSPKHLHPQTTQSSRPGTERALGFHQVSGTGGEAWGPLLQKGPRQITVSP

SEQ ID NO: 793164 - protein, 152 aa, Homo sapiens
KGKGEQRENRPKWLTKKLKKIYLQKMGKRKLRRVQPLMKQERKKPSLINNHIPCLISGPCLPSCTIQRNIFINYFVNASFLVALETFLRRRESHLIPFFKCKCFFLRGEIICWLFIFWYNQKIVWDIELWEALTVSGVSLTFHRWGVSFYIL

SEQ ID NO: 793165 - protein, 152 aa, Homo sapiens; identical to SEQ ID NO: 793164

SEQ ID NO: 793166 - protein, 152 aa, Homo sapiens; identical to SEQ ID NO: 793164

SEQ ID NO: 793167 - protein, 38 aa, Homo sapiens
MVFAISPEGLNSPSIFCHREQGGLTVLQMRRPSVHLAS

SEQ ID NO: 793168 - protein, 241 aa, Homo sapiens
MQDPNEDTEWNDILRDFGILPPKEESKDEIEEMVLRLQKEAMVKPFEKMTLAQLKEAEDEFDEEDMQAVETYRKKRLQEWKALKKKQKFGELREISGNQYVNEVTNAEEDVWVIIHLYRSSIPMCLLVNQHLSLLARKFPETKFVKAIVNSCIQHYHDNCLPTIFVYKNGQIEAKFIGIIECGGINLKLEELEWKLAEVGAIQTDLEENPRKDMVDMMVSSIRNTSIHDDSDSSNSDNDTK

SEQ ID NO: 793169 - protein, 122 aa, Homo sapiens
MQDPNEDTEWNDILRDFGILPPKEESKDEIEEMVLRLQKEAMVKPFEKMTLAQLKEAEDEFDEEDMQAVETYRKKRLQEWKALKKKQKFGELREISGNQYVNEVTNAEEDVWVIIHLYRSRT

SEQ ID NO: 793170 - protein, 70 aa, Homo sapiens
NLVLWVPESQGVSGSQPYPGPLKREFLRPHDITRNTGRSCISFLLFYFLSRIALCQNALTFVEHVMNSDE

SEQ ID NO: 793171 - protein, 90 aa, Homo sapiens
IGEKRITLGRDRTGFLPGQGSKSSALKVPSAAKLLIICLPAFEGSGVDCDDCKNPESGMLVPELPPASFPFPAFPRQHPGENLRTLSTTV

SEQ ID NO: 793172 - protein, 271 aa, Homo sapiens
MLLAPPSTPSRGRTPSAVERLEADKAKYVKTHQVIARRQEPALRGSPGPLTPHPCNELGPPASPRTPRPVRRGSGRRLPRPDSLIFYRQKRDCKASVNKENAKGQGLVRRLFLGAPRDAAPSSPASTERPAASGGWAAPQDAPEAAGKRALCPTCSLPLSEKERFFNYCGLERALVEVLGAERFSPQSWGADASPQAGTSPPPGSGDASDWTSSDRGVDSPGGAGGGGGSEAAGSARDRRPPVSVVERNARVIQWLYGCQRARGPPRESEV

SEQ ID NO: 793173 - protein, 123 aa, Homo sapiens
TLRSPGTLGLVSAQEPSASQNVEITGVSHHAPLTFFSSVHYSRGELRVVLHMCTALSFMDLLGWLHPPSVSPSCSSSTWLVPVGHFWKFMPVQSTLSTSSFCVTELTMLGFIYVSLATRSFTS

SEQ ID NO: 793174 - protein, 468 aa, Homo sapiens
KKIRGKEVYMTMAYGKGDPLLPPRLQHSMHYGHDPPMHYSQTAGNVMSNEHFHPQHPSPRQGRGYGMPRNSSRFINRHNMPGPKVDFYPGPGKRCCQSYDNFSYRSRSFRRSHRQMSCVNKESQYGFTPGNGQMPRGLEETITFYEVEEGDETAYPTLPNHGGPSTMVPATSGYCVGRRGHSSGKQTLNLEEGNGQSENGRYHEEYLYRAEPDYETSGVYSTTASTANLSLQDRKSCSMSPQDTVTSYNYPQKMMGNIAAVAASCANNVPAPVLSNGAAANQAISTTSVSSQNAIQPLFVSPPTHGRPDTKVLQYYFNLGLQCYYHSYWHSMVYVPQMQQQLHVENYPVYTEPPLVDQTVPQCYSEVRREDGIQAEASANDTFPNADSSSVPHGAVYYPVMSDPYGQPPLPGFDSCLPVVPDYSCVPPWHPVGTAYGGSSQIHGAINPGPIGCIAPSPPASHYVPQGM

SEQ ID NO: 793175 - protein, 211 aa, Homo sapiens
MLVPLYHHHHHHHHHHHHHHLLLLLLLLLLLLLLLMWERLQTYNHHHHYHLHLIPVIQAAVICLKCYYHSYWHSMVYVPQMQQQLHVENYPVYTEPPLVDQTVPQCYSEVRREDGIQAEASANDTFPNADSSSVPHGAVYYPVMSDPYGQPPLPGFDSCLPVVPDYSCVPPWHPVGTAYGGSSQIHGAINPGPIGCIAPSPPASHYVPQGM

SEQ ID NO: 793176 - protein, 539 aa, Homo sapiens
KKIRGKEVYMTMAYGKGDPLLPPRLQHSMHYGHDPPMHYSQTAGNVMSNEHFHPQHPSPRQGRGYGMPRNSSRFINRHNMPGPKVDFYPGPGKRCCQSYDNFSYRSRSFRRSHRQMSCVNKESQYGFTPGNGQMPRGLEETITFYEVEEGDETAYPTLPNHGGPSTMVPATSGYCVGRRGHSSGKQTLNLEEGNGQSENGRYHEEYLYRAEPDYETSGVYSTTASTANLSLQDRKSCSMSPQDTVTSYNYPQKMMGNIAAVAASCANNVPAPVLSNGAAANQAISTTSVSSQNAIQPLFVSPPTHGRPVIASPSYPCHSAIPHAGASLPPPPPPPPPPPPPPPPPPPPPPPPPPPALDVGETSNLQPPPPLPPPPYSCDPSGSDLPQDTKVLQYYFNLGLQCYYHSYWHSMVYVPQMQQQLHVENYPVYTEPPLVDQTVPQCYSEVRREDGIQAEASANDTFPNADSSSVPHGAVYYPVMSDPYGQPPLPGFDSCLPVVPDYSCVPPWHPVGTAYGGSSQIHGAINPGPESRPLFFWQF

SEQ ID NO: 793177 - protein, 248 aa, Homo sapiens
KKIRGKEVYMTMAYGKGDPLLPPRLQHSMHYGHDPPMHYSQTAGNVMSNEHFHPQHPSPRQGRGYGMPRNSSRFINRHNMPGPKVDFYPGPGKRCCQSYDNFSYRSRSFRRSHRQMSCVNKESQYGFTPGNGQMPRGLEETITFYEVEEGDETAYPTLPNHGGPSTMVPATSGYCVGRRGHSSGKQTLNLEEGNGQSENGRYHEEYLYRAVSSGQKVMFYVSSGHSYLIQLPPEDDGKYCSSCSFLCQ

SEQ ID NO: 793178 - protein, 137 aa, Homo sapiens [sequence omitted]

SEQ ID NO: 793179 - protein, 211 aa, Homo sapiens; identical to SEQ ID NO: 793175

SEQ ID NO: 793180 - protein, 211 aa, Homo sapiens; identical to SEQ ID NO: 793175

SEQ ID NO: 793181 - protein, 226 aa, Homo sapiens
MLVPLYHHHHHHHHHHHHHHLLLLLLLLLLLLLLLMWERLQTYNHHHHYHLHLIPVIQAAVICLKCYYHSYWHSMVYVPQMQQQLHVENYPVYTEPPLVDQTVPQCYSEVRREDGIQAEASANDTFPNADSSSVPHGAVYYPVMSDPYGQPPLPGFDSCLPVVPDYSCVPPWHPVGTAYGGSSQIHGAINPGPIGCIAPSPPASHYVPQESKTKSLCFWITHLILN

SEQ ID NO: 793182 - protein, 72 aa, Homo sapiens
ARIQASNDVRGHGCLGSMTTFQLECTHCPRNPAFQGGSAFDSARRFVGPDGVGLWLRTWRRCAFASIVGHSF

SEQ ID NO: 793183 - protein, 111 aa, Homo sapiens
MAPDEPQYPQVLVKELVLPPAFPHMGSCSSSHTASDSLYRTCPQMSSETGNTGRPVAQTQEEPAERLRGGIADGVTRMKMPTSVLLPENNCQASMSFQLELFLFSPCLSLF

SEQ ID NO: 793184 - protein, 81 aa, Homo sapiens
SKEWSILFIKSIWNSIVCESVQEHNESQSEKNFGFLVPTALLFRYSLLFCYVKRELEFHVKYKNQGEESCLGPSSIIALWS

SEQ ID NO: 793185 - protein, 104 aa, Homo sapiens [sequence omitted]

SEQ ID NO: 793186 - protein, 120 aa, Homo sapiens
SGNLPLSLLTSLPPPPLQHLPSSHQQFPADHPALIPNFTPPNKAQYRPSGWCMGFIFLVNTFLTNHYHLLFCAKLQSDGTKCRYSACPSLGWFFSVVFTPVFERVPGVVLPATAAQGLTG

SEQ ID NO: 793187 - protein, 102 aa, Homo sapiens
KSGRECPAWPVWLPRESLILTRFGWSQQGGEEKKAHSGCWSRGRFSDSSPRCSLGRGPSGVCSTLPRLETALLSKPQSRDKQPKFYGWGGWAKMGGRTCPGS

SEQ ID NO: 793188 - protein, 102 aa, Homo sapiens
NPDELLSSQVPSTIPSHLAYSGHHTLITLGSFHFLKLEELFSPRGHTCCSLGLQRSSSTVRGWIPIYFGLSSSVISLQKPSLVVSLGAATKHPKPIFLFALY

SEQ ID NO: 793189 - protein, 140 aa, Homo sapiens
RFSAPAPWPEPQACRYPHPGHAFLPRGRTAPESRALAGNSQAPGSRGRKCDEEAGPARTCGSGQEPRPPRALLLAHDGGRRRPLLPGPMNKAGDAALESALGPASSLGFGDRSPGRSLRIGGQGLRGVCDSGPPAGQQRP

SEQ ID NO: 793190 - protein, 449 aa, Homo sapiens
MATRSSDWLRRPLGEDNQPETQLFWDKEPWFWHDTLTEQLWRIFAGVHDEKAKPRDRQQAPGLGQESKAPGSCDPGTDPCPEDASTPRPPEASSSPPEGSQDRNTSWGVVQEPPGRASRFLQSISWDPEDFEDAWKRPDALPGQSKRLAVPCKLEKMRILAHGELVLATAISSFTRHVFTCGRRGIKVWSLTGQVAEDRFPESHLPIQTPGAFLRTCLLSSNSRSLLTGGYNLASVSVWDLAAPSLHVKEQLPCAGLNCQALDANLDANLAFASFTSGVVRIWDLRDQSVVRDLKGYPDGVKSIVVKGYNIWTGGPDACLRCWDQRTIMKPLEYQFKSQIMSLSHSPQEDWVLLGMANGQQWLQSTSGSQRHMVGQKDSVILSVKFSPFGQWWASVGMDDFLGVYSMPAGTKVFEVPEMSPVTCCDVSSNNRLVVTGSGEHASVYQITY

SEQ ID NO: 793191 - protein, 571 aa, Homo sapiens
ARGNLADLRSFRPVRDPCPGISNSESSPTLNYQGILNRLKQFPRFSPHFAAELESIYYSLHKIQQDVAEHHKQIGNVLQIVESCSQLQGFQSEEVSPAEPASPGTPQQVKDKTLQESSFEDIMATRSSDWLRRPLGEDNQPETQLFWDKEPWFWHDTLTEQLWRIFAGVHDEKAKPRDRQQAPGLGQESKAPGSCDPGTDPCPEDASTPRPPEASSSPPEGSQDRNTSWGVVQEPPGRASRFLQSISWDPEDFEDAWKRPDALPGQSKRLAVPCKLEKMRILAHGELVLATAISSFTRHVFTCGRRGIKVWSLTGQVAEDRFPESHLPIQTPGAFLRTCLLSSNSRSLLTGGYNLASVSVWDLAAPSLHVKEQLPCAGLNCQALDANLDANLAFASFTSGVVRIWDLRDQSVVRDLKGYPDGVKSIVVKGYNIWTGGPDACLRCWDQRTIMKPLEYQFKSQIMSLSHSPQEDWVLLGMANGQQWLQSTSGSQRHMVGQKDSVILSVKFSPFGQWWASVGMDDFLGVYSMPAGTKVFEVPEMSPVTCCDVSSNNRLVVTGSGEHASVYQITY

SEQ ID NO: 793192 - protein, 245 aa, Homo sapiens
PRRARCLGSPGSSGEPRGGGRGKGGKRRWWRPRPAGGQLRVLCAQEKRRLQEEIRAARREVEEEKLRVERLKRKSLRERWLMDGAAAVPEPSEDPTSKDPQSPEGQAQARIRNLEDSLFTLQSQLQLLQSASTGAQHKPSGRPSWRRQGHRPLSQSIVEAGSVGQTDLNKRASLPAGLVGTPPESPSEPREDVLGFLPGPRQVPGAAGDSSEANGPCPSPIPTPEQGLSQRAVPSEGRVGEAKGG

SEQ ID NO: 793193 - protein, 207 aa, Homo sapiens
GGDKIPAQPAEVGRGLYMDRGSLYAQPQLPSPAQRKSLRERWLMDGAAAVPEPSEDPTSKDPQSPEGQAQARIRNLEDSLFTLQSQLQLLQSASTGAQHKPSGRPSWRRQGHRPLSQSIVEAGSVGQTDLNKRASLPAGLVGTPPESPSEPREDVLGFLPGPRQVPGAAGDSSEANGPCPSPIPTPEQGLSQRAVPSEGRVGEAKGG

SEQ ID NO: 793194 - protein, 173 aa, Homo sapiens
RGCPGPSLRTHFDPRKGGRAGTETAATRQCPAFTAASANHRPAPPGPVRRHRPLLRPEENLALVGHLRLIQSERAALPRRPARGRGLGSRRRGVPRGQGRELRAGRAAPSARTRRCPFKMILLPGPSSALAAPPQGAATSGLPDWRRRRPLGQLPVPAGCPAHRRRRRGALQA

SEQ ID NO: 793195 - protein, 662 aa, Homo sapiens [sequence omitted]

SEQ ID NO: 793196 - protein, 289 aa, Homo sapiens
FVESSPPVSLLPQPTKFMVGTEQGIVISCNRKAKTSAEKIVCTFPGHHGPIYALQRNPFYPKNFLTVGDWTARIWSEDSRESSIMWTKYHMAYLTDAAWSPVRPTVFFTTRMDGTLDIWDFMFEQCDPTLSLKVCDEALFCLRVQDNGCLIACGSQLGTTTLLEVSPGLSTLQRNEKNVASSMFERETRREKILEARHREMRLKEKGKAEGRDEEQTDEELAVDLEALVSKAEEEFFDIIFTELKKKEADAIKLTPVPQQPSPEEDQVVEEGEEAAGEEGDEEVEEDLA

SEQ ID NO: 793197 - protein, 640 aa, Homo sapiens
TGKRRPFEEHRSRDRGLDASPETQKQKERTQAAGTMEIVYVYVKKRSEFGKQCNFSDRQAELNIDIMPNPELAEQFVERNPVDTGIQCSISMSEHEANSERFEMETRGVNHVEGGWPKDVNPLELEQTIRFRKKVEKDENYVNAIMQLGSIMEHCIKQNNAIDIYEEYFNDEEAMEVMEEDPSAKTINVFRDPQEIKRAATHLSWHPDGNRKLAVAYSCLDFQRAPVGMSSDSYIWDLENPNKPELALKPSSPLVTLEFNPKDSHVLLGGCYNGQIACWDTRKGSLVAELSTIESSHRDPVYGTIWLQSKTGTECFSASTDGQVMWWDIRKMSEPTEVVILDITKKEQLENALGAISLEFESTLPTKFMVGTEQGIVISCNRKAKTSAEKIVCTFPGHHGPIYALQRNPFYPKNFLTVGDWTARIWSEDSRESSIMWTKYHMAYLTDAAWSPVRPTVFFTTRMDGTLDIWDFMFEQCDPTLSLKVCDEALFCLRVQDNGCLIACGSQLGTTTLLEVSPGLSTLQRNEKNVASSMFERETRREKILEARHREMRLKEKGKAEGRDEEQTDEELAVDLEALVSKAEEEFFDIIFTELKKKEADAIKLTPVPQQPSPEEDQVVEEGEEAAGEEGDEEVEEDLA

SEQ ID NO: 793198 - protein, 599 aa, Homo sapiens
TGKRRPFEEHRSRDRGLDASPETQKQKERTQAAGTMEIVYVYVKKRSEFGKQCNFSDRQAELNIDIMPNPELAEQFVERNPVDTGIQCSISMSEHEANSERFEMETRGVNHVEGGWPKDVNPLELEQTIRFRKKVEKDENYVNAIMQLGSGPPGNQEGCQHLSWHPDGNRKLAVAYSCLDFQRAPVGMSSDSYIWDLENPNKPELALKPSSPLVTLEFNPKDSHVLLGGCYNGQIACWDTRKGSLVAELSTIESSHRDPVYGTIWLQSKTGTECFSASTDGQVMWWDIRKMSEPTEVVILDITKKEQLENALGAISLEFESTLPTKFMVGTEQGIVISCNRKAKTSAEKIVCTFPGHHGPIYALQRNPFYPKNFLTVGDWTARIWSEDSRESSIMWTKYHMAYLTDAAWSPVRPTVFFTTRMDGTLDIWDFMFEQCDPTLSLKVCDEALFCLRVQDNGCLIACGSQLGTTTLLEVSPGLSTLQRNEKNVASSMFERETRREKILEARHREMRLKEKGKAEGRDEEQTDEELAVDLEALVSKAEEEFFDIIFTELKKKEADAIKLTPVPQQPSPEEDQVVEEGEEAAGEEGDEEVEEDLA

SEQ ID NO: 793199 - protein, 332 aa, Homo sapiens
GRSLAMEGSNGFGIDSILSHRAGSPALPKGDPLLGDCRSPLELSPRSESSSDCSSPASPGRDCLETGTPRPGGASGPGLDSHLQPGQLSAPAQSRTVTSSFLIRDILADCKPLAACAPYSSSGQPAAPEPGGRLAAKAAEDFRDKLDKSGSNASSDSEYKVKEEGDREISSSRDSPPVRLKKPRKARTAFTDHQLAQLERSFERQKYLSVQDRMELAASLNLTDTQVKTWYQNRRTKWKRQTAVGLELLAEAGNYSALQRMFPSPYFYPQSLVSNLDPGAALYLYRGPSAPPPALQRPLVPRILIHGLQGASEPPPPLPPLAGVLPRAAQPR

SEQ ID NO: 793200 - protein, 132 aa, Homo sapiens
MENLPINNGSGQSYGLVLYEKSICSGGRLRAHAHDMAQVFLDETMIGILNENNKDLHIPELRDCRYLRILVENQGRVNFSWQIQNEQKGITGSVSINNSSLEGFTIYSLEMKMSFFERLRSATWKPVPDSHQ

SEQ ID NO: 793201 - protein, 493 aa, Homo sapiens
MERSPDVSPGPSRSFKEELLCAVCYDPFRDAVTLRCGHNFCRGCVSRCWEVQVSPTCPVCKDRASPADLRTNHTLNNLVEKLLREEAEGARWTSYRFSRVCRLHRGQLSLFCLEDKELLCCSCQADPRHQGHRVQPVKDTAHDFRAKCRNMEHALREKAKAFWAMRRSYEAIAKHNQVEAAWLEGRIRQEFDKLREFLRVEEQAILDAMAEETRQKQLLADEKMKQLTEETEVLAHEIERLQMEMKEDDVSFLMKHKSRKRRLFCTMEPEPAQPGMLIDVCKYLGSLQYRVWKKMLASVESVPFSFDPNTAAGWLSVSDDLTSVTNHGYRVQVENPERFSSAPCLLGSRVFSQGSHAWEVALGGLQSWRVGVVRVRQDSGAEGHSHSCYHDTRSGFWYVCRTQGVEGDHCVTSDPATSPLVLAIPRRLRVELECEEGELSFYDAERHCHLYTFHARFGEVRPYFYLGGARGAGPPEPLRICPLHISVKEELDG

SEQ ID NO: 793202 - protein, 158 aa, Homo sapiens
GTLEHPHLLPHDQGHRVQPVKDTAHDFRAKCRNMEHALREKAKAFWAMRRSYEAIAKHNQVEAAWLEGRIRQEFDKLREFLRVEEQAILDAMAEETRQKQLLADEKMKQLTEETEVLAHEIERLQMEMKEDDVSFLMVRSSASGFSDRATCSRTSWEP

SEQ ID NO: 793203 - protein, 376 aa, Homo sapiens
GTLEHPHLLPHDQGHRVQPVKDTAHDFRAKCRNMEHALREKAKAFWAMRRSYEAIAKHNQVEAAWLEGRIRQEFDKLREFLRVEEQAILDAMAEETRQKQLLADEKMKQLTEETEVLAHEIERLQMEMKEDDVSFLMKHKSRKRRLFCTMEPEPAQPGMLIDVCKYLGSLQYRVWKKMLASVESVPFSFDPNTAAGWLSVSDDLTSVTNHGYRVQVENPERFSSAPCLLGSRVFSQGSHAWEVALGGLQSWRVGVVRVRQDSGAEGHSHSCYHDTRSGFWYVCRTQGVEGDHCVTSDPATSPLVLAIPRRLRVELECEEGELSFYDAERHCHLYTFHARFGEVRPYFYLGGARGAGPPEPLRICPLHISVKEELDG

SEQ ID NO: 793204 - protein, 530 aa, Homo sapiens
MERSPDVSPGPSRSFKEELLCAVCYDPFRDAVTLRCGHNFCRGCVSRCWEVQVSPTCPVCKDRASPADLRTNHTLNNLVEKLLREEAEGARWTSYRFSRVCRLHRGQLSLFCLEDKELLCCSCQADPRHQGHRVQPVKDTAHDFRVRSLIAEERRNFLPTHQWIVTKTRLQTSSPNLQSRRQAKCRNMEHALREKAKAFWAMRRSYEAIAKHNQVEAAWLEGRIRQEFDKLREFLRVEEQAILDAMAEETRQKQLLADEKMKQLTEETEVLAHEIERLQMEMKEDDVSFLMKHKSRKRRLFCTMEPEPAQPGMLIDVCKYLGSLQYRVWKKMLASVESVPFSFDPNTAAGWLSVSDDLTSVTNHGYRVQVENPERFSSAPCLLGSRVFSQGSHAWEVALGGLQSWRVGVVRVRQDSGAEGHSHSCYHDTRSGFWYVCRTQGVEGDHCVTSDPATSPLVLAIPRRLRVELECEEGELSFYDAERHCHLYTFHARFGEVRPYFYLGGARGAGPPEPLRICPLHISVKEELDG

SEQ ID NO: 793205 - protein, 376 aa, Homo sapiens; identical to SEQ ID NO: 793203

SEQ ID NO: 793206 - protein, 218 aa, Homo sapiens
GTLEHPHLLPHDQGHRVQPVKDTAHDFRAKCRNMEHALREKAKAFWAMRRSYEAIAKHNQVEAAWLEGRIRQEFDKLREFLRVEEQAILDAMAEETRQKQLLADEKMKQLTEETEVLAHEIERLQMEMKEDDVSFLMKHKSRKRRLFCTMEPEPAQPGMLIDVCKYLGSLQYRVWKKMLASVESVPFSFDPNTAAGWLSVSDDLTSVTNHGYRVQEQC

SEQ ID NO: 793207 - protein, 218 aa, Homo sapiens; identical to SEQ ID NO: 793206

SEQ ID NO: 793208 - protein, 108 aa, Homo sapiens
CTQRAGSRSLHRLSATASLAAYLAPPAGLPPYLPSRCRFQCPCARGTREAARESPGALSLSLSALWPRLWEGTASEPGVLWGLLPWEESVPSPPQPSLPAHLGRGRAA

SEQ ID NO: 793209 - protein, 108 aa, Homo sapiens
MGLCLLEIISKNLHLFLTFVFFLRVLFFSCTQTLQVLVHQSDLLIHLSATGLCQLSSFFCAFHVSFNDHQLTSHLFILPICLICNVLSFFELDFLEFHLLHLLRPRFQ

SEQ ID NO: 793210 - protein, 145 aa, Homo sapiens
MLSRSYSSNLRMEELYGLKNHKLLSKSYSSAPKSSKTELFKEPNAEGRRLSLTSGLIGILTPSSSSSSQLAPNGAKCIPVRDRGFLVQTIEFAEQRIPVLNEYCVVCDEPHVFPFQTLGVMNEAADEIATGAQVVDLLVSMCRSA

SEQ ID NO: 793211 - protein, 168 aa, Homo sapiens
MFWKLSLSLFLVAVLVKVAEARKNRPAGAIPSPYKDGSSNNSERWQHQIKEVLASSQEALVVTERKYLKSDWCKTQPLRQTVSEEGCRSRTILNRFCYGQCNSFYIPRHVKKEEESFQSCAFCKPQRVTSVLVELECPGLDPPFRLKKIQKVKQCRCMSVNLSDSDKQ

SEQ ID NO: 793212 - protein, 112 aa, Homo sapiens
DRAMQDLPGIRCEPLFLTQLSPWRSFHFLCILLPPPWLVSISDLNPHQITSFFLTVLSQLTPNVTTIKLKTILPKPGLTLKLPLLISGTMFKRLTTLNYCFFSFVSTSTPLP

SEQ ID NO: 793213 - protein, 238 aa, Homo sapiens
YSLTNRGFGEAMSYFRTPQTHPGPLPSGQGGAASPGLSLGLCSPVEPVVVASGGTGPLSQKAEQVAPAAQAWGPALAMPQARGCPGGTSWETLRKEYSRNCHKFPHVRQLESLGWDNGYSRSRAPDLGGPSRPRPLMLCGLSPRVLPVPSEAVGKEASSQPDICILTLAMMIAGIPTVPVPGVREEDLIWAAQAFMMAHPEPEGAVEGARWEQAHAHTASGKMPLVRSKRGQPPGSCL

SEQ ID NO: 793214 - protein, 175 aa, Homo sapiens
RRCARATRGGGGCARATRGGDLGWAVALPHRPSALAGPLPSQTAERQARPLVRELGRGSAAAGCPSLPGATTPRPRRCCVPRDLWGGRESLRVPFQPTWSWDTPPRNLVGTAQGIPAAGFWPQHALRQPGERPCGLQVPVGCVRRGQKNHVFFQSGAPFGCLFTKRFRSRKKIHC

SEQ ID NO: 793215 - protein, 188 aa, Homo sapiens
TLRAGHARRRRLRAGHARRRLGLGGRPAPPPFGARRSAPLPNRRAAGAAAGSRARPGQRSRRLPLAPRRHNPAPSPLLRPARPVGRPGVTSGSLSAHVVLGHSTQEPSRHRAGNPSSGVLAPARVAAAWRASLRPPSAGGVRAQGAGKKHPQVSVLNIFSDQDYKRSVITIATSVDKLGIRLNIRHLS

SEQ ID NO: 793216 - protein, 121 aa, Homo sapiens
ARYPERVGKIMSSSRVGLRLAACLLNVSEAGRKYIVENIAKAALLDKNGKKHPQVSVLNIFSDQDYKRSVITIATSVDKLETESHHVAQAGLQLLSSRNLPAWASQSAEIRGVSHYPQQGP

SEQ ID NO: 793217 - protein, 288 aa, Homo sapiens
TLRAGHARRRRLRAGHARRRLGLGGRPAPPPFGARRSAPLPNRRAAGAAAGSRARPGQRSRRLPLAPRRHNPAPSPLLRPARPVGRPGVTSGSLSAHVVLGHSTQEPSRHRAGNPSSGVLAPARVCGSLASVLAASKCRWGACAGGRKIMSSSRVGLRLAACLLNVSEAGRKYIVENIAKAALLDKNGKKHPQVSVLNIFSDQDYKRSVITIATSVDKLGLAEDLVLHVPGCSVFLFGEADLPEKRSLVQRRKQLGWFTRRDFSALQPDLGAAPSQRCGLTVDKRNQA

SEQ ID NO: 793218 - protein, 175 aa, Homo sapiens; identical to SEQ ID NO: 793214

SEQ ID NO: 793219 - protein, 175 aa, Homo sapiens; identical to SEQ ID NO: 793214

SEQ ID NO: 793220 - protein, 489 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQGTSLGQVSFSKLGSFGAVIQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 793221 - protein, 347 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQLPNGVLSCGLL

SEQ ID NO: 793222 - protein, 288 aa, Homo sapiens
MRALSLLTEPSVDGDVMRLTADEWSHLESIKAVGSAGAGLETQWDDDVWLPDPVIGGASGRLYLSPRLPRVSVAGCEERPLGWVWVLGGGGFLPARPPRAQRHLGFSHAEQSMEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKVSRGYVSRQETEFHTHGSAEEILIKRLFAEV

SEQ ID NO: 793223 - protein, 484 aa, Homo sapiens
MVNVKALCEPEVSNCWMNVITGTGSVSSPLLVLPQPGPETSLMTGEPVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQGTSLGQVSFSKLGSFGAVIQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 793224 - protein, 381 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQGTSLGQVSFSKLGSFGAVIQVVLIFLVSFWKPIIASVQQTCLLGL

SEQ ID NO: 793225 - protein, 362 aa, Homo sapiens
MPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQGTSLGQVSFSKLGSFGAVIQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 793226 - protein, 441 aa, Homo sapiens
VPEFPVAAITRTRWAQLELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQGTSLGQVSFSKLGSFGAVIQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 793227 - protein, 381 aa, Homo sapiens; identical to SEQ ID NO: 793224

SEQ ID NO: 793228 - protein, 343 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQQTCLLGL

SEQ ID NO: 793229 - protein, 493 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQSCNPSGNPSLPLFSKPVSWDSRPSTSWTFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 793230 - protein, 489 aa, Homo sapiens; identical to SEQ ID NO: 793220

SEQ ID NO: 793231 - protein, 138 aa, Homo sapiens
MRLPCPEACSYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 793232 - protein, 522 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQGTSLGQVSFSKLGSFGAVIQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLWRGKNLNWTWPGKNLTGPLGLEKKAACPFPGFPQGFWENPAPGAPHLGGGKKKTDPAHWFQSPGGKPQGSWTP

SEQ ID NO: 793233 - protein, 396 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQGTSLGQVSFSKLGSFGAVIQVVLIFYLMVSSVVGFYSSPLFRSLRPRWHDTAMTQVAGRE

SEQ ID NO: 793234 - protein, 347 aa, Homo sapiens; identical to SEQ ID NO: 793221

SEQ ID NO: 793235 - protein, 332 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSCSCVPSTSERACRYRARLS

SEQ ID NO: 793236 - protein, 374 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLGMWLRRAWDTWVSPRRVAPGSRCLLTASHPCTEKRRKASAWQRNLGYPLAMLCLLVLTVGIPALEVRSGPSVLEAFSGRGEAMQGPGYHQ

SEQ ID NO: 793237 - protein, 138 aa, Homo sapiens
MVNVKALCEPEVSNCWMNVITGTGSVSSPLLVLPQPGPETSLMTGEPVDDEDATVNKIALELCTFTLAIALGAVLLLPFSIISNEVLLSLPRNYYIQWLNGSLIHGLWNLVFLFSNLSLISQICLHINLPHCCSGPSP

SEQ ID NO: 793238 - protein, 176 aa, Homo sapiens [sequence omitted]

SEQ ID NO: 793239 - protein, 124 aa, Homo sapiens
MVNVKALCEPEVSNCWMNVITGTGSVSSPLLVLPQPGPETSLMTGEPVDDEDATVNKIALELCTFTLAIALGAVLLLPFSIISNEVLLSLPRNYYIQWLNGSLIHGLWNLVFLFSNLSLISSRA

SEQ ID NO: 793240 - protein, 95 aa, Homo sapiens
NLSVAVLKCGHQEAAESWAGSRKGPGEPTSHPGLCASGLTRFDLLGDFGRFNWLGNFYIVFLYNAAFAGLTTLCLVKTFTAAVRAELIRAFGERE

SEQ ID NO: 793241 - protein, 158 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVKLSGEGNRVL

SEQ ID NO: 793242 - protein, 673 aa, Homo sapiens
MGNQNGNPTGTLGAWGNLLPQESTEPQTSTSQNVSFSAQPQNLNTDGPNNTNPMNSSPNPINAMQTNGLPNWGMAVGMGAIIPPHLQGLPGANGSSVSQVSGGSAEGISNSVWGLSPGNPATGNSNSGFSQGNGDTVNSALSAKQNGSSSAVQKEGSGGNAWDSGPPAGPGILAWGRGSGNNGVGNIHSGAWGHPSRSTSNGVNGEWGKPPNQHSNSDINGKGSTGWESPSVTSQNPTVQPGGEHMNSWAKAASSGTTASEGSSDGSGNHNEGSTGREGTGEGRRRDKGIIDQGHIQLPRNDLDPRVLSNTGWGQTPVKQNTAWEFEESPRSERKNDNGTEAWGCAATQASNSGGKNDGSIMNSTNTSSVSGWVNAPPAAVPANTGWGDSNNKAPSGPGVWGDSISSTAVSTAAAAKSGHAWSGAANQEDKSPTWGEPPKPKSQHWGDGQRSNPAWSAGGGDWADSSSVLGHLGDGKKNGSGWDADSNRSGSGWNDTTRSGNSGWGNSTNTKANPGTNWGETLKPGPQQNWASKPQDNNVSNWGGAASVKQTGTGWIGGPVPVKQKDSSEATGWEEPSPPSIRRKMEIDDGTSAWGDPSNYNNKTVNMWDRNNPVIQSSTTTNTTTTTTTTTSNTTHRVETPPPHQAGTQLNRSPLLGPGRKGISCFFTSKKK

SEQ ID NO: 793243 - protein, 136 aa, Homo sapiens
MNVNSMDMTGGLSVKDPSQSQSRLPQWTHPNSMDNLPSAASPLEQNPSKHGAIPGGLSIGPPGKSSIDDSYGRYDLIQNSESPASPPVAVPHSWSRAKSDSDKISNGSSINWPPGKTMQHFCATAAGQNVLQACRE

SEQ ID NO: 793244 - protein, 1551 aa, Homo sapiens
MGNQNGNPTGTLGAWGNLLPQESTEPQTSTSQNVSFSAQPQNLNTDGPNNTNPMNSSPNPINAMQTNGLPNWGMAVGMGAIIPPHLQGLPGANGSSVSQVSGGSAEGISNSVWGLSPGNPATGNSNSGFSQGNGDTVNSALSAKQNGSSSAVQKEGSGGNAWDSGPPAGPGILAWGRGSGNNGVGNIHSGAWGHPSRSTSNGVNGEWGKPPNQHSNSDINGKGSTGWESPSVTSQNPTVQPGGEHMNSWAKAASSGTTASEGSSDGSGNHNEGSTGREGTGEGRRRDKGIIDQGHIQLPRNDLDPRVLSNTGWGQTPVKQNTAWEFEESPRSERKNDNGTEAWGCAATQASNSGGKNDGSIMNSTNTSSVSGWVNAPPAAVPANTGWGDSNNKAPSGPGVWGDSISSTAVSTAAAAKSGHAWSGAANQEDKSPTWGEPPKPKSQHWGDGQRSNPAWSAGGGDWADSSSVLGHLGDGKKNGSGWDADSNRSGSGWNDTTRSGNSGWGNSTNTKANPGTNWGETLKPGPQQNWASKPQDNNVSNWGGAASVKQTGTGWIGGPVPVKQKDSSEATGWEEPSPPSIRRKMEIDDGTSAWGDPSNYNNKTVNMWDRNNPVIQSSTTTNTTTTTTTTTSNTTHRVETPPPHQAGTQLNRSPLLGPVSSGWGEMPNVHSKTENSWGEPSSPSTLVDNGTAAWGKPPSSGSGWGDHPAEPPVAFGRAGAPVAASALCKPASKSMQEGWGSGGDEMNLSTSQWEDEEGDVWNNAASQESTSSCSSWGNAPKKGLQKGMKTSGKQDEAWIMSRLIKQLTDMGFPREPAEEALKSNNMNLDQAMSALLEKKVDVDKRGLGVTDHNGMAAKPLGCRPPISKESSVDRPTFLDKDGGLVEEPTPSPFLPSPSLKLPLSHSALPSQALGGIASGLGMQNLNSSRQIPSGNLGMFGNSGAAQARTMQQPPQPPVQPLNSSQPSLRAQVPQFLSPQVQAQLLQFAAKNIGLNPALLTSPINPQHMTMLNQLYQLQLAYQRLQIQQQMLQAQRNVSGSMRQQEQQVARTITNLQQQIQQHQRQLAQALLVKQPPPPPPPPHLSLHPSAGKSAMDSFPSHPQTPGLPDLQTKEQQSSPNTFAPYPLAGLNPNMNVNSMDMTGGLSVKDPSQSQSRLPQWTHPNSMDNLPSAASPLEQNPSKHGAIPGGLSIGPPGKSSIDDSYGRYDLIQNSESPASPPVAVPHSWSRAKSDSDKISNGSSINWPPEFHPGVPWKGLQNIDPENDPDVTPGSVPTGPTINTTIQDVNRYLLKSGGKLSDIKSTWSSGPTSHTQASLSHELWKVPRNSTAPTRPPPGLTNPKPSSTWGASPLGWTSSYSSGSAWSTDTSGRTSSWLVLRNLTPQIDGSTLRTLCLQHGPLITFHLNLTQGNAVVRYSSKEEAAKAQKSLHMCVLGNTTILAEFAGEEEVNRFLAQGQALPPTSSWQSSSASSQPRLSAAGSSHGLVRSDAGHWNAPCLGGKGSSELLWGGVPQYSSSLWGPPSADDSRVIGSPTPLTTLLPGDLLSGESL

SEQ ID NO: 793245 - protein, 1551 aa, Homo sapiens; identical to SEQ ID NO: 793244

SEQ ID NO: 793246 - protein, 1590 aa, Homo sapiens
MGNQNGNPTGTLGAWGNLLPQESTEPQTSTSQNVSFSAQPQNLNTDGPNNTNPMNSSPNPINAMQTNGLPNWGMAVGMGAIIPPHLQGLPGANGSSVSQVSGGSAEGISNSVWGLSPGNPATGNSNSGFSQGNGDTVNSALSAKQNGSSSAVQKEGSGGNAWDSGPPAGPGILAWGRGSGNNGVGNIHSGAWGHPSRSTSNGVNGEWGKPPNQHSNSDINGKGSTGWESPSVTSQNPTVQPGGEHMNSWAKAASSGTTASEGSSDGSGNHNEGSTGREGTGEGRRRDKGIIDQGHIQLPRNDLDPRVLSNTGWGQTPVKQNTAWEFEESPRSERKNDNGTEAWGCAATQASNSGGKNDGSIMNSTNTSSVSGWVNAPPAAVPANTGWGDSNNKAPSGPGVWGDSISSTAVSTAAAAKSGHAWSGAANQEDKSPTWGEPPKPKSQHWGDGQRSNPAWSAGGGDWADSSSVLGHLGDGKKNGSGWDADSNRSGSGWNDTTRSGNSGWGNSTNTKANPGTNWGETLKPGPQQNWASKPQDNNVSNWGGAASVKQTGTGWIGGPVPVKQKDSSEATGWEEPSPPSIRRKMEIDDGTSAWGDPSNYNNKTVNMWDRNNPVIQSSTTTNTTTTTTTTTSNTTHRVETPPPHQAGTQLNRSPLLGPVSSGWGEMPNVHSKTENSWGEPSSPSTLVDNGTAAWGKPPSSGSGWGDHPAEPPVAFGRAGAPVAASALCKPASKSMQEGWGSGGDEMNLSTSQWEDEEGDVWNNAASQESTSSCSSWGNAPKKGLQKGMKTSGKQDEAWIMSRLIKQLTDMGFPREPAEEALKSNNMNLDQAMSALLEKKVDVDKRGLGVTDHNGMAAKPLGCRPPISKESSVDRPTFLDKDGGLVEEPTPSPFLPSPSLKLPLSHSALPSQALGGIASGLGMQNLNSSRQIPSGNLGMFGNSGAAQARTMQQPPQPPVQPLNSSQPSLRAQVPQFLSPQVQAQLLQFAAKNIGLNPALLTSPINPQHMTMLNQLYQLQLAYQRLQIQQQMLQAQRNVSGSMRQQEQQVARTITNLQQQIQQHQRQLAQALLVKQPPPPPPPPHLSLHPSAGKSAMDSFPSHPQTPGLPDLQTKEQQSSPNTFAPYPLAGLNPNMNVNSMDMTGGLSVKDPSQSQSRLPQWTHPNSMDNLPSAASPLEQNPSKHGAIPGGLSIGPPGKSSIDDSYGRYDLIQNSESPASPPVAVPHSWSRAKSDSDKISNGSSINWPPEFHPGVPWKGLQNIDPENDPDVTPGSVPTGPTINTTIQDVNRYLLKSGGSSPPSSQNATLPSSSAWPLSASGYSSSFSSIASAPSVAGKLSDIKSTWSSGPTSHTQASLSHELWKVPRNSTAPTRPPPGLTNPKPSSTWGASPLGWTSSYSSGSAWSTDTSGRTSSWLVLRNLTPQIDGSTLRTLCLQHGPLITFHLNLTQGNAVVRYSSKEEAAKAQKSLHMCVLGNTTILAEFAGEEEVNRFLAQGQALPPTSSWQSSSASSQPRLSAAGSSHGLVRSDAGHWNAPCLGGKGSSELLWGGVPQYSSSLWGPPSADDSRVIGSPTPLTTLLPGDLLSGESL

SEQ ID NO: 793247 - protein, 456 aa, Homo sapiens
MNVNSMDMTGGLSVKDPSQSQSRLPQWTHPNSMDNLPSAASPLEQNPSKHGAIPGGLSIGPPGKSSIDDSYGRYDLIQNSESPASPPVAVPHSWSRAKSDSDKISNGSSINWPPEFHPGVPWKGLQNIDPENDPDVTPGSVPTGPTINTTIQDVNRYLLKSGGSSPPSSQNATLPSSSAWPLSASGYSSSFSSIASAPSVAGKLSDIKSTWSSGPTSHTQASLSHELWKVPRNSTAPTRPPPGLTNPKPSSTWGASPLGWTSSYSSGSAWSTDTSGRTSSWLVLRNLTPQIDGSTLRTLCLQHGPLITFHLNLTQGNAVVRYSSKEEAAKAQKSLHMCVLGNTTILAEFAGEEEVNRFLAQGQALPPTSSWQSSSASSQPRLSAAGSSHGLVRSDAGHWNAPCLGGKGSSELLWGGVPQYSSSLWGPPSADDSRVIGSPTPLTTLLPGDLLSGESL

SEQ ID NO: 793248 - protein, 739 aa, Homo sapiens
MGNQNGNPTGTLGAWGNLLPQESTEPQTSTSQNVSFSAQPQNLNTDGPNNTNPMNSSPNPINAMQTNGLPNWGMAVGMGAIIPPHLQGLPGANGSSVSQVSGGSAEGISNSVWGLSPGNPATGNSNSGFSQGNGDTVNSALSAKQNGSSSAVQKEGSGGNAWDSGPPAGPGILAWGRGSGNNGVGNIHSGAWGHPSRSTSNGVNGEWGKPPNQHSNSDINGKGSTGWESPSVTSQNPTVQPGGEHMNSWAKAASSGTTASEGSSDGSGNHNEGSTGREGTGEGRRRDKGIIDQGHIQLPRNDLDPRVLSNTGWGQTPVKQNTAWEFEESPRSERKNDNGTEAWGCAATQASNSGGKNDGSIMNSTNTSSVSGWVNAPPAAVPANTGWGDSNNKAPSGPGVWGDSISSTAVSTAAAAKSGHAWSGAANQEDKSPTWGEPPKPKSQHWGDGQRSNPAWSAGGGDWADSSSVLGHLGDGKKNGSGWDADSNRSGSGWNDTTRSGNSGWGNSTNTKANPGTNWGETLKPGPQQNWASKPQDNNVSNWGGAASVKQTGTGWIGGPVPVKQKDSSEATGWEEPSPPSIRRKMEIDDGTSAWGDPSNYNNKTVNMWDRNNPVIQSSTTTNTTTTILAEFAGEEEVNRFLAQGQALPPTSSWQSSSASSQPRLSAAGSSHGLVRSDAGHWNAPCLGGKGSSELLWGGVPQYSSSLWGPPSADDSRVIGSPTPLTTLLPGDLLSGESL

SEQ ID NO: 793249 - protein, 1447 aa, Homo sapiens
MGNQNGNPTGTLGAWGNLLPQESTEPQTSTSQNVSFSAQPQNLNTDGPNNTNPMNSSPNPINAMQTNGLPNWGMAVGMGAIIPPHLQGLPGANGSSVSQVSGGSAEGISNSVWGLSPGNPATGNSNSGFSQGNGDTVNSALSAKQNGSSSAVQKEGSGGNAWDSGPPAGPGILAWGRGSGNNGVGNIHSGAWGHPSRSTSNGVNGEWGKPPNQHSNSDINGKGSTGWESPSVTSQNPTVQPGGEHMNSWAKAASSGTTASEGSSDGSGNHNEGSTGREGTGEGRRRDKGIIDQGHIQLPRNDLDPRVLSNTGWGQTPVKQNTAWEFEESPRSERKNDNGTEAWGCAATQASNSGGKNDGSIMNSTNTSSVSGWVNAPPAAVPANTGWGDSNNKAPSGPGVWGDSISSTAVSTAAAAKSGHAWSGAANQEDKSPTWGEPPKPKSQHWGDGQRSNPAWSAGGGDWADSSSVLGHLGDGKKNGSGWDADSNRSGSGWNDTTRSGNSGWGNSTNTKANPGTNWGETLKPGPQQNWASKPQDNNVSNWGGAASVKQTGTGWIGGPVPVKQKDSSEATGWEEPSPPSIRRKMEIDDGTSAWGDPSNYNNKTVNMWDRNNPVIQSSTTTNTTTTTTTTTSNTTHRVETPPPHQAGTQLNRSPLLGPVSSGWGEMPNVHSKTENSWGEPSSPSTLVDNGTAAWGKPPSSGSGWGDHPAEPPVAFGRAGAPVAASALCKPASKSMQEGWGSGGDEMNLSTSQWEDEEGDVWNNAASQESTSSCSSWGNAPKKGLQKGMKTSGKQDEAWIMSRLIKQLTDMGFPREPAEEALKSNNMNLDQAMSALLEKKVDVDKRGLGVTDHNGMAAKPLGCRPPISKESSVDRPTFLDKDGGLVEEPTPSPFLPSPSLKLPLSHSALPSQALGGIASGLGMQNLNSSRQIPSGNLGMFGNSGAAQARTMQQPPQPPVQPLNSSQPSLRAQVPQFLSPQVQAQLLQFAAKNIGLNPALLTSPINPQHMTMLNQLYQLQLAYQRLQIQQQMLQAQRNVSGSMRQQEQQVARTITNLQQQIQQHQRQLAQALLVKQPPPPPPPPHLSLHPSAGKSAMDSFPSHPQTPGLPDLQTKEQQSSPNTFAPYPLAGLNPNMNVNSMDMTGGLSVKDPSQSQSRLPQWTHPNSMDNLPSAASPLEQNPSKHGAIPGGLSIGPPGKSSIDDSYGRYDLIQNSESPASPPVAVPHSWSRAKSDSDKISNGSSINWPPEFHPGVPWKGLQNIDPENDPDVTPGSVPTGPTINTTIQDVNRYLLKSGGSSPPSSQNATLPSSSAWPLSASGYSSSFSSIASAPSVAGKLSDIKSTWSSGPTSHTQASLSHELWKVPRNSTAPTRPPPGLTNPKPSSTWGASPLGWTSSYSSGSAWSTDTSGRTSSWLVLRNLTPQVQYGAPASLSMIQGGFPLGPQCR

SEQ ID NO: 793250 - protein, 1219 aa, Homo sapiens
MGNQNGNPTGTLGAWGNLLPQESTEPQTSTSQNVSFSAQPQNLNTDGPNNTNPMNSSPNPINAMQTNGLPNWGMAVGMGAIIPPHLQGLPGANGSSVSQVSGGSAEGISNSVWGLSPGNPATGNSNSGFSQGNGDTVNSALSAKQNGSSSAVQKEGSGGNAWDSGPPAGPGILAWGRGSGNNGVGNIHSGAWGHPSRSTSNGVNGEWGKPPNQHSNSDINGKGSTGWESPSVTSQNPTVQPGGEHMNSWAKAASSGTTASEGSSDGSGNHNEGSTGREGTGEGRRRDKGIIDQGHIQLPRNDLDPRVLSNTGWGQTPVKQNTAWEFEESPRSERKNDNGTEAWGCAATQASNSGGKNDGSIMNSTNTSSVSGWVNAPPAAVPANTGWGDSNNKAPSGPGVWGDSISSTAVSTAAAAKSGHAWSGAANQEDKSPTWGEPPKPKSQHWGDGQRSNPAWSAGGGDWADSSSVLGHLGDGKKNGSGWDADSNRSGSGWNDTTRSGNSGWGNSTNTKANPGTNWGETLKPGPQQNWASKPQDNNVSNWGGAASVKQTGTGWIGGPVPVKQKDSSEATGWEEPSPPSIRRKMEIDDGTSAWGDPSNYNNKTVNMWDRNNPVIQSSTTTNTTTTTTTTTSNTTHRVETPPPHQAGTQLNRSPLLGPVSSGWGEMPNVHSKTENSWGEPSSPSTLVDNGTAAWGKPPSSGSGWGDHPAEPPVAFGRAGAPVAASALCKPASKSMQEGWGSGGDEMNLSTSQWEDEEGDVWNNAASQESTSSCSSWGNAPKKGLQKGMKTSGKQDEAWIMSRLIKQLTDMGFPREPAEEALKSNNMNLDQAMSALLEKKVDVDKRGLGVTDHNGMAAKPLGCRPPISKESSVDRPTFLDKDGGLVEEPTPSPFLPSPSLKLPLSHSALPSQALGGIASGLGMQNLNSSRQIPSGNLGMFGNSGAAQARTMQQPPQPPVQPLNSSQPSLRAQVPQFLSPQVQAQLLQFAAKNIGLNPALLTSPINPQHMTMLNQLYQLQLAYQRLQIQQQMLQAQRNVSGSMRQQEQQVARTITNLQQQIQQHQRQLAQALLVKQPPPPPPPPHLSLHPSAGKSAMDSFPSHPQTPGLPDLQTKEQQSSPNTFAPYPLAGLNPNMNVNSMDMTGGLSVKDPSQSQSRLPQWTHPNSMDNLPSAASPLEQNPSKHGTSELGCLWWDHCWLINRSSCCIAWPFYTFLRIEH

SEQ ID NO: 793251 - protein, 53 aa, Homo sapiens
INTTIQDVNRYLLKSGGEGAALPASAWTVSLDPFGDVRGDRLGCEAGMIQGTV

SEQ ID NO: 793252 - protein, 93 aa, Homo sapiens
SRGPRDGLGPEPQEPPPGPPPSPAAAPEAVPPPPAPPSYSDKGVQTPSKGTPAPLPNGNHRYCRLCNIKFSSLSTFIAHKKYYCSSHAAEHVK

SEQ ID NO: 793253 - protein, 74 aa, Homo sapiens
APSPPSADVNLTPPPAPPSYSDKGVQTPSKGTPAPLPNGNHRYCRLCNIKFSSLSTFIAHKKYYCSSHAAEHVK

SEQ ID NO: 793254 - protein, 727 aa, Homo sapiens
MDSDMDYERPNVETIKCVVVGDNAVGKTRLICARACNATLTQYQLLATHVPTVWAIDQYRVCQEVLERSRDVVDDVSVSLRLWDTFGDHHKDRRFAYGRSDVVVLCFSIANPNSLHHVKTMWYPEIKHFCPRAPVILVGCQLDLRYADLEAVNRARRPLARPIKPNEILPPEKGREVAKELGIPYYETSVVAQFGIKDVFDNAIRAALISRRHLQFWKSHLRNVQRPLLQAPFLPPKPPPPIIVVPDPPSSSEEGPAHLLEDPLCADVILVLQERVRIFAHKIYLSTSSSKFYDLFLMDLSEGELGGPSEPGGTHPEDHQGHSDQHHHHHHHHHGRDFLLRAASFDVCESVDEAGGSGPAGLRASTSDGILRGNGTGYLPGRGRVLSSWSRAFVSIQEEMAEDPLTYKSRLMVVVKMDSSIQPGPFRAVLKYLYTGELDENERDLMHIAHIAELLEVFDLRMMVANILNNEAFMNQEITKAFHVRRTNRVKECLAKGTFSDVTFILDDGTISAHKPLLISSCDWMAAMFGGPFVESSTREVVFPYTSKSCMRAVLEYLYTGMFTSSPDLDDMKLIILANRLCLPHLVALTEQYTVTGLMEATQMMVDIDGDVLVFLELAQFHCAYQLADWCLHHICTNYNNVCRKFPRDMKAMSPENQEYFEKHRWPPVWYLKEEDHYQRARKEREKEDYLHLKRQPKRRWLFWNSPSSPSSSAASSSSPSSSSAVV

SEQ ID NO: 793255 - protein, 727 aa, Homo sapiens; identical to SEQ ID NO: 793254

SEQ ID NO: 793256 - protein, 176 aa, Homo sapiens
MQAWRKGPDGPQKTSSDSMSRLMDSDMDYERPNVETIKCVVVGDNAVGKTRLICARACNATLTQYQLLATHVPTVWAIDQYRVCQEVLERSRDVVDDVSVSLRLWDTFGDHHKDRRFAYGRSDVVVLCFSIANPNSLHHVKTMWYPEIKHFCPRAPVILVGCQLDLRYADLEAVNR

SEQ ID NO: 793257 - protein, 749 aa, Homo sapiens
MQAWRKGPDGPQKTSSDSMSRLMDSDMDYERPNVETIKCVVVGDNAVGKTRLICARACNATLTQYQLLATHVPTVWAIDQYRVCQEVLERSRDVVDDVSVSLRLWDTFGDHHKDRRFAYGRSDVVVLCFSIANPNSLHHVKTMWYPEIKHFCPRAPVILVGCQLDLRYADLEAVNRARRPLARPIKPNEILPPEKGREVAKELGIPYYETSVVAQFGIKDVFDNAIRAALISRRHLQFWKSHLRNVQRPLLQAPFLPPKPPPPIIVVPDPPSSSEEGPAHLLEDPLCADVILVLQERVRIFAHKIYLSTSSSKFYDLFLMDLSEGELGGPSEPGGTHPEDHQGHSDQHHHHHHHHHGRDFLLRAASFDVCESVDEAGGSGPAGLRASTSDGILRGNGTGYLPGRGRVLSSWSRAFVSIQEEMAEDPLTYKSRLMVVVKMDSSIQPGPFRAVLKYLYTGELDENERDLMHIAHIAELLEVFDLRMMVANILNNEAFMNQEITKAFHVRRTNRVKECLAKGTFSDVTFILDDGTISAHKPLLISSCDWMAAMFGGPFVESSTREVVFPYTSKSCMRAVLEYLYTGMFTSSPDLDDMKLIILANRLCLPHLVALTEQYTVTGLMEATQMMVDIDGDVLVFLELAQFHCAYQLADWCLHHICTNYNNVCRKFPRDMKAMSPENQEYFEKHRWPPVWYLKEEDHYQRARKEREKEDYLHLKRQPKRRWLFWNSPSSPSSSAASSSSPSSSSAVV

SEQ ID NO: 793258 - protein, 749 aa, Homo sapiens; identical to SEQ ID NO: 793257

SEQ ID NO: 793259 - protein, 576 aa, Homo sapiens
MLGFLLEPTRPIKPNEILPPEKGREVAKELGIPYYETSVVAQFGIKDVFDNAIRAALISRRHLQFWKSHLRNVQRPLLQAPFLPPKPPPPIIVVPDPPSSSEEGPAHLLEDPLCADVILVLQERVRIFAHKIYLSTSSSKFYDLFLMDLSEGELGGPSEPGGTHPEDHQGHSDQHHHHHHHHHGRDFLLRAASFDVCESVDEAGGSGPAGLRASTSDGILRGNGTGYLPGRGRVLSSWSRAFVSIQEEMAEDPLTYKSRLMVVVKMDSSIQPGPFRAVLKYLYTGELDENERDLMHIAHIAELLEVFDLRMMVANILNNEAFMNQEITKAFHVRRTNRVKECLAKGTFSDVTFILDDGTISAHKPLLISSCDWMAAMFGGPFVESSTREVVFPYTSKSCMRAVLEYLYTGMFTSSPDLDDMKLIILANRLCLPHLVALTEQYTVTGLMEATQMMVDIDGDVLVFLELAQFHCAYQLADWCLHHICTNYNNVCRKFPRDMKAMSPENQEYFEKHRWPPVWYLKEEDHYQRARKEREKEDYLHLKRQPKRRWLFWNSPSSPSSSAASSSSPSSSSAVV

SEQ ID NO: 793260 - protein, 203 aa, Homo sapiens
MAAMFGGPFVESSTREVVFPYTSKSCMRAVLEYLYTGMFTSSPDLDDMKLIILANRLCLPHLVALTEQYTVTGLMEATQMMVDIDGDVLVFLELAQFHCAYQLADWCLHHICTNYNNVCRKFPRDMKAMSPENQEYFEKHRWPPVWYLKEEDHYQRARKEREKEDYLHLKRQPKRRWLFWNSPSSPSSSAASSSSPSSSSAVV

SEQ ID NO: 793261 - protein, 164 aa, Homo sapiens
GDVAVWFDRGLEQSILPVFLGSLLLIPIFLLGCGLRCCHPLLTLLLLSPSAFTPLLFRITPSTLQGPGGPRNQDPEGGALLTSHRGSAREELSPVEQNGNHLQRSPDPKQDGRQLLGGAKSPGILSLGLRALESKGKPPSLQGFSVCLGCCSGQGGSPTPSKQK

SEQ ID NO: 793262 - protein, 293 aa, Homo sapiens
RRLLLATRRALSGAADLMDADSLLLSLELASGSGQGLSPDRRASLLTSLMLVKRDYRYDRVLFWGRILGLVADYYIAQGLSEDQLAPRKTLYSLNCTEWSLLPPATEEMVAQSSVVKGRFMGDPSYEYEHTELQKVNEGEKVFEEEIVVQIKEETRLVSVIDQIDKAVAIIPRGALFKTPFGPTHVNRTFEGLSLSEAKKLSSYFHFREPVELKNKTLLEKADLDPSLDFMDSLEHDIPKGSWSIQMERGNALVVLRSLLWPGLTFYHAPRTKNYGYVYVGTGEKNMDLPFML

SEQ ID NO: 793263 - protein, 338 aa, Homo sapiens
RRLLLATRRALSGAADLMDADSLLLSLELASGSGQGLSPDRRASLLTSLMLVKRDYRYDRVLFWGRILGLVADYYIAQGLSEDQLAPRKTLYSLNCTEWSLLPPATEEMVAQSSVVKGRFMGDPSYEYEHTELQKVNEGEKVFEEEIVVQIKEETRLVSVIDQIDKAVAIIPRGALFKTPFGPTHVNRTFEGLSLSEAKKLSSYFHFREPVELKNKTLLEKADLDPSLDFMDSLEHDIPKGSEAVVQGDFTWLLSRCGFGWPCSWDSCSVSMRVLEHPDGEGQCPGGAAQPALAGPHLLPCSPHQELWLRLRGHWREEHGLALHAIEWEPAWMFLNRV

SEQ ID NO: 793264 - protein, 265 aa, Homo sapiens
RRLLLATRRALSGAADLMDADSLLLSLELASGSGQGLSPDRRASLLTSLMLVKRDYRYDRVLFWGRILGLVADYYIAQGLSEDQLAPRKTLYSLNCTEWSLLPPATEEMVAQSSVVKGRFMGDPSYEYEHTELQKVNEGEKVFEEEIVVQIKEETRLVSVIDQIDKAVAIIPRGALFKTPFGPTHVNRTFEGLSLSEAKKLSSYFHFREPVELKNKTLLEKADLDPSLDFMDSLEHDIPKGSWSIQMERGNALVGYDVPTCFVSS

SEQ ID NO: 793265 - protein, 194 aa, Homo sapiens
RRLLLATRRALSGAADLMDADSLLLSLELASGSGQGLSPDRRASLLTSLMLVKRDYRYDRVLFWGRILGLVADYYIAQGLSEDQLAPRKTLYSLNCTEWSLLPPATEEMVAQSSVVKGRFMGDPSYEYEHTELQKVNEGEKVFEEEIVVQIKEETRLVSVIDQIDKAVAIIPRGALFKTPFGPTHVNRTFEELV

SEQ ID NO: 793266 - protein, 85 aa, Homo sapiens
GTRVYTMDRGLISYKGLHPFHVEKGVKPLGQLAPAPAPSQSSCGVKRGSPCLLGFLTQAAALALPCPSKAIMVPSRQSGAGLGDI

SEQ ID NO: 793267 - protein, 517 aa, Homo sapiens
MAALRLLASVLGRGVPAGGSGLALSQGCARCFATSPRLRAKFYADPVEMVKDISDGATVMIGGFGLCGIPENLIAALLRTRVKDLQVVSSNVGVEDFGLGLLLAARQVRRIVCSYVGENTLCESQYLAGELELELTPQGTLAERIRAGGAGVPAFYTPTGYGTLVQEGGAPIRYTPDGHLALMSQPREVREFNGDHFLLERAIRADFALVKGWKADRAGNVVFRRSARNFNVPMCKAADVTAVEVEEIVEVGAFPPEDIHVPNIYVDRVIKGQKYEKRIERLTILKEEDGDAGKEEDARTRIIRRAALEFEDGMYANLGIGIPLLASNFISPSMTVHLHSENGILGLGPFPTEDEVDADLINAGKQTVTVLPGGCFFASDDSFAMIRGGHIQLTMLGAMQVSKYGDLANWMIPGKKVKGMGGAMDLVSSQKTRVVVTMQHCTKDNTPKIMEKCTMPLTGKRCVDRIITEKAVFDVHRKKELTLRELWEGLTVDDIKKSTGCAFAVSPNLRPMQQVAP

SEQ ID NO: 793268 - protein, 526 aa, Homo sapiens
MAALRLLASVLGRGVPAGGSGLALSQGCARCFATSPRLRAKFYADPVEMVKDISDGATVMIGGFGLCGIPENLIAALLRTRVKDLQVVSSNVGVEDFGLGLLLAARQVRRIVCSYVGENTLCESQYLAGELELELTPQGTLAERIRAGGAGVPAFYTPTGYGTLVQEGGAPIRYTPDGHLALMSQPREVREFNGDHFLLERAIRADFALVKGWKADRAGNVVFRRSARNFNVPMCKAADVTAVEVEEIVEVGAFPPEDIHVPNIYVDRVIKGQKYEKRIERLTILKEEDGDAGKEEDARTRIIRRAALEFEDGMYANLGIGIPLLASNFISPSMTVHLHSENGILGLGPFPTEDEVDADLINAGKQTVTVLPGGCFFASDDSFAMIRGGHIQLTMLGAMQVSKYGDLANWMIPGKKVKGMGGAMDLVSSQKTRVVVTMQHCTKDNTPKIMEKCTMPLTGKRCVDRIITEKAVFDVHRKKELTLRELWEGLTVDDIKKSTGCAFAVSPNLRPMQQVDSAPLESCDFN

SEQ ID NO: 793269 - protein, 143 aa, Homo sapiens
KADLAVAAFTITAEREKVIDFSKPFMTLGISILYRVHMGRKPGYFSFLDPFSPAVWLFMLLAYLAVSCVLFLAARLSPYEWYNPHPCLRARPHILENQYTLGNSLWFPTLLEVGRASGQMGVPWCPSTLLFLSFLGGETSEFL

SEQ ID NO: 793270 - protein, 109 aa, Homo sapiens
PDKNSGSTVPLPGQSTVGKGQAHKVGLQRPLRTPATVSGGTSWPSLLPFDPPPGPLPQINCCHSYQGKGCLSTGMLPAEELCPGASAGKAARRVAVPGAAQRGETKLHK

SEQ ID NO: 793271 - protein, 129 aa, Homo sapiens
LFPSTGPVGSVFKVYPESHHFSSASVPTSSHFGGPVPLEESVELSGSFSLLCISMDASLVPATYTHLDFWNILLTPLLSSHTCFLPSYFPMAARMGILKCKSDHIVLMLKTFPYFFMILRIKRNLFMNL

SEQ ID NO: 793272 - protein, 93 aa, Homo sapiens
PVSAWLRNKVCQRQWWGVRHSRRFGATVCREPCSCYVSFARCHTNTAPRGAHSVQAGTGWCQWPLQIVPRCVALGTHGFPGELPYHLGLTLRD

SEQ ID NO: 793273 - protein, 189 aa, Homo sapiens
MGYRVRVSPAPAQPTSRRILISKDPWSLGSHPSGLSGRPLPFTRRAGSARSALRTRSLGRPEPDGPAGVGRRRNGLAFRDQREGGPRCPSGRVLSTRSPHSQGLASGGARTGAWGRRRRSQKGPSGAETFGGRRGLRVSMAGSGMRLDRPGRRSGTRREAEGLASSRTSICSEPGRGFGIRSLTPCVSS

SEQ ID NO: 793274 - protein, 189 aa, Homo sapiens; identical to SEQ ID NO: 793273

SEQ ID NO: 793275 - protein, 109 aa, Homo sapiens
SGQPTQAPPLGGGPSDFRVLKPGMTEQPRESACSSLLDTTEVFAFLTSGWPHPDSSTWGSTNQLSARGQLLLLMISPLTQPVSTPHSLAPYLSNYLKNPLTSEPLVRWI

SEQ ID NO: 793276 - protein, 123 aa, Homo sapiens
RPPRVGAGSSGDVGRGPGGGEAPGGQARGREAPGNPQPLRRPSQGARARKRPVCTRPPPSPRPARAPRSLEPERWLRAAWRGGEACPPPPLPPTPRCGSEEQLPLAGARRGRAAAPTGAGKRP

SEQ ID NO: 793277 - protein, 293 aa, Homo sapiens
MDTAKSKSESPKELVQLKKLFIGGLSFETTNESLRSHSEQWGTLADCVVMRDPNTKHSRGFGFATYATEEEVDAATNARPHKVDGRVVEPKRAVSREDSQRPDAHLTMEKIFVGGINEDTEEYHLSDYFEQYGKTEVIEIMTDQGSGKKRGFAFVTFDDHDSVDKTVIQKYHTVNGHNCEIRKGLSKQEMVSASSSQRGQSTSGNFGGGRGGGFGRNDNFGCEGNFSGHGGFGGSCGGGGYRAVGMAIMDLVMMEAILEVEATMILAIIYQISPSLNVSLLLTLSILSIIAGS

SEQ ID NO: 793278 - protein, 257 aa, Homo sapiens
MPARCVAAHCGNTTKSGKSLFRFPKDRAVRLLWDRFVRGCRADWYGGNDRSVICSDHFAPACFDVSSVIQKNLRFSQRLRLVAGAVPTLHRVPAPAPKRGEEGDQAGRLDTRGELQAARHSEAAPGPVSCTRPRAGKQAAASQITCENELVQTQPHADNPSNTVTSVPTHCEEGPVHKSTQISLKRPRHRSVGIQAKVKAFGKRLCNATTQTEELWSRTSSLFDIYSSDSETDTDWDIKSEQSDLSYMAVQVKEETC

SEQ ID NO: 793279 - protein, 138 aa, Homo sapiens
MEAVNKLSLRLQRTLVACAGSSSDQYASGHGCPGPCSVVKQVLAAEAIEMETGRSAVDESHYLLSLTLFGLNKLPVFLTNRGRVGTEPQKSSLDFLLIGHWKFKRLTRKQVSICTPTLCNRLHTICSIWHPFLRLDSQ

SEQ ID NO: 793280 - protein, 138 aa, Homo sapiens; identical to SEQ ID NO: 793279

SEQ ID NO: 793281 - protein, 167 aa, Homo sapiens
RDLPPAAKQQDGAAAMEMQPLKSAEGGDADDRKKASMHKKEKSVLQGKLTKLAVQIGKAGLVMSAITVIILVLYFTVDTFVVNKKPWLPECTPVYVQYFVKFFIIGVTVLVVAVPEGLPLAVTISLAYSVKVRGEESRTSRLMQLQLRAWGNHWGWCWGWEMNEEAP

SEQ ID NO: 793282 - protein, 132 aa, Homo sapiens
EEKDLLKAERCLLETLALAPHEEYIQRHLNIVRDKISSSSFIEPIFPTSKISSVEGKKIPTESVKEIRGESRQTQIVKTSDNKSQSKSNKQLGKNGDEETPHKTTKDIKEIEKKRVAALKRLEEIERILNGE

SEQ ID NO: 793283 - protein, 104 aa, Homo sapiens
MRSSAASPTSLPAFADPAAVPPLEHVYVWTLLLCQRWCTYMYMDSTATTLTKHCCCPPPIPPIGVLLPADWGHIGPSSDSRSENKAMGLVPAPRVRACRPRVLN

SEQ ID NO: 793284 - protein, 126 aa, Homo sapiens
MGLGQSNLNTPLSASLSQCPCLATPSCTSPTSLPAFADPAAVPPLEHVYVWTLLLCQRWCTYMYMDSTATTLTKHCCCPPPIPPIGVLLPADWGHIGPSSDSRSENKAMGLVPAPRVRACRPRVLN

SEQ ID NO: 793285 - protein, 1170 aa, Homo sapiens [sequence omitted]

SEQ ID NO: 793286 - protein, 503 aa, Homo sapiens
MELGGPSEMEEVRCPEHGTFCFLKTGVRDGPNKGKSFYVCRADTCSFVRATDIPVSHCLLHEDFVVELQGLLLPQDKKEYRLFFRCIRSKAEGKRWCGSIPWQDPDSKEHSVSNKSQHASETFHHSSNWLRNPFKVLDKNQEPALWKQLIKGEGEEKKADKKQREKGDQLFDQKKEQKPEMMEKDLSSGLVPKKKQSVVQEKKQEEGAEIQCEAETGGTHKRDFSEIKSQQCQGNELTRPSASSQEKSSGKSQDVQRESEPLREKVTQLLPQNVHSHNSISKPQKGGPLNKEYTNWEAKETKAKDGPSIQATQKSLPQGHFQERPETHSVPAPGGPAAQAAPAAPGLSLGEGREAATSSDDEEEDDVVFVSSKPGSPLLFDSTLDLETKENLQFPDRSVQRKVSPASGVSKKVEPSDPVARRVYLTTQLKQKKSTLASVNIQALPDKGQKLIKQIQELEEVLSGLTLSPEQGKVAYASELRVCIDFTRDIREALLIKNVLIQK

SEQ ID NO: 793287 - protein, 989 aa, Homo sapiens
MEKDLSSGLVPKKKQSVVQEKKQEEGAEIQCEAETGGTHKRDFSEIKSQQCQGNELTRPSASSQEKSSGKSQDVQRESEPLREKVTQLLPQNVHSHNSISKPQKGGPLNKEYTNWEAKETKAKDGPSIQATQKSLPQGHFQERPETHSVPAPGGPAAQAAPAAPGLSLGEGREAATSSDDEEEDDVVFVSSKPGSPLLFDSTLDLETKENLQFPDRSVQRKVSPASGVSKKVEPSDPVARRVYLTTQLKQKKSTLASVNIQALPDKGQKLIKQIQELEEVLSGLTLSPEQGTNEKSNSQVPQQSHFTKTTTGPPHLVPPQPLPRRGTQPVGSLELKSACQVTAGGSSQCYRGHTNQDHVHAVWKITSEAIGQLHRSLESCPGETVVAEDPAGLKVPLLLHQKQALAWLLWRESQKPQGGILADDMGLGKTLTMIALILTQKNQEKKEEKEKSTALTWLSKDDSCDFTSHGTLIICPASLIHHWKNEVEKRVNSNKLRVYLYHGPNRDSRARVLSTYDIVITTYSLVAKEIPTNKQEAEIPGANLNVEGTSTPLLRIAWARIILDEAHNVKNPRVQTSIAVCKLQACARWAVTGTPIQNNLLDMYSLLKFLRCSPFDEFNLWRSQVDNGSKKGGERLSILTKSLLLRRTKDQLDSTGRPLVILPQRKFQLHHLKLSEDEETVYNVFFARSRSALQSYLKRHESRGNQSGRSPNNPFSRVALEFGSEEPRHSEAADSPRSSTVHILSQLLRLRQCCCHLSLLKSALDPMELKGEGLVLSLEEQLSALTLSELRDSEPSSTVSLNGTFFKMELFEGMRESTKISSLLAELEAIQRNSASQKSVIVSQWTNMLKVVALHLKKHGLTYATIDGSVNPKQRMDLVEAFNHSRGPQVMLISLLAGGVGLNLTGGNHLFLLDMHWNPSLEDQACDRIYRVGQQKDVVIHRFVCEGTVEEKILQLQEKKKDLAKQVLSGSGESVTKLTLADLRVLFGI

SEQ ID NO: 793288 - protein, 387 aa, Homo sapiens
MYSLLKFLRCSPFDEFNLWRSQVDNGSKKGGERLSILTKSLLLRRTKDQLDSTGRPLVILPQRKFQLHHLKLSEDEETVYNVFFARSRSALQSYLKRHESRGNQSGRSPNNPFSRVALEFGSEEPRHSEAADSPRSSTVHILSQLLRLRQCCCHLSLLKSALDPMELKGEGLVLSLEEQLSALTLSELRDSEPSSTVSLNGTFFKMELFEGMRESTKISSLLAELEAIQRNSASQKSVIVSQWTNMLKVVALHLKKHGLTYATIDGSVNPKQRMDLVEAFNHSRGPQVMLISLLAGGVGLNLTGGNHLFLLDMHWNPSLEDQACDRIYRVGQQKDVVIHRFVCEGTVEEKILQLQEKKKDLAKQVLSGSGESVTKLTLADLRVLFGI

SEQ ID NO: 793289 - protein, 1301 aa, Homo sapiens
MARNCSECKEKRAAHILCTYCNRWLCSSCTEEHRHSPVPGGPFFPRAQKGSPGVNGGPGDFTLYCPLHTQEVLKLFCETCDMLTCHSCLVVEHKEHRCRHVEEVLQNQRMLLEGVTTQVAHKKSSLQTSAKQIEDRIFEVKHQHRKVENQIKMAKMVLMNELNKQANGLIEELEGITNERKRKLEQQLQSIMVLNRQFEHVQNFINWAVCSKTSVPFLFSKELIVFQMQRLLETSCNTDPGSPWSIRFTWEPNFWTKQLASLGCITTEGGQMSRADAPAYGGLQGSSPFYQSHQSPVAQQEALSHPSHKFQSPAVCSSSVCCSHCSPVSPSLKGQVPPPSIHPAHSFRQPPEMVPQQLGSLQCSALLPREKELACSPHPPKLLQPWLETQPPVEQESTSQRLGQQLTSQPVCIVPPQDVQQGAHAQPTLQTPSIQVQFGHHQKLKLSHFQQQPQQQLPPPPPPLPHPPPPLPPPPQQPHPPLPPSQHLASSQHESPPGPACSQNMDIMHHKFELEEMQKDLELLLQAQQPSLQLSQTKSPQHLQQTIVGQINYIVRQPAPVQSQSQEETLQATDEPPASQGSKPALPLDKNTAAALPQASGEETPLSVPPVDSTIQHSSPNVVRKHSTSLSIMGFSNTLEMELSSTRLERPLEPQIQSVSNLTAGAPQAVPSLLSAPPKMVSSLTSVQNQAMPSLTTSHLQTVPSLVHSTFQSMPNLISDSPQAMASLASDHPQAGPSLMSGHTQAVPSLATCPLQSIPPVSDMQPETGSSSSSGRTSGSLCPRDGADPSLENALCKVSPGEMLSKLPLFIIGQKIGHWDPYSDLSLTVLRPLMTTMSEFFDSCRHFTFEKMESEDSTRFTDLLGQGPIVPGLDAPKDLAIPSELEEPINLSVKKPPLAPVVSTSTALQQYQNPKECENFEQGALELDAKENQSIRAFNSEHKIPYVRLERLKICAASSGEMPVFKLKPQKNDQDGSFLLIIECGTESSSMSIKVSQDRLSEATQAPGLEGRKVTVTSLAGQRPPEVEGTSPEEHRLIPRTPGAKKGPPAPIENEDFCAVCLNGGELLCCDRCPKVFHLSCHVPALLSFPGGEWVCTLCRSLTQPEMEYDCENACYNQPGMRASPGLSMYDQKKCEKLVLSLCCNNLSLPFHEPVSPLARHYYQIIKRPMDLSIIRRKLQKKDPAHYTTPEEVVSDVRLMFWNCAKFNYPDSEVAEAGRCLEVFFEGWLKEIYPEKRFAQPRQEDSDSEEVSSESGCSTPQGFPWPPYMQEGIQPKRRRRHMENERAKRMSFRLANSISQV

SEQ ID NO: 793290 - protein, 103 aa, Homo sapiens
MYNVYSHNPAPESQRGSTSRLAIPSQLSKGRKSAMKKKSHPFFPHGHRRLASRHVDSQPWGPEVLEKKSQKDRKGFGKNSFVPSAQMVILGTVSLWLLITVHI

SEQ ID NO: 793291 - protein, 109 aa, Homo sapiens
MEPELVPVLVPGAAHYHSSWHAWLCTVARPHTHLLTYPWPLCTWIALGGMGSRTVVWTECSLLGRVARATGHRGFWLGNWHQKNKSCVTKSAFTSVRNERGDENISSKC

SEQ ID NO: 793292 - protein, 228 aa, Homo sapiens
VLPTSKSPQSILTSQFPIPSLFATISQPLIQPQCPECHESLGLTQDSGLQRTPGPSKDSRVPRNLDLAQNPDLYKNPGLTQDPGLHENPGLAPNQGLHEFPGLPQDSYLCQNPSPSQDFGLHKNSGITQDSHPQKNTGLTQEAGILRSPCLTQSPGLHKKTPFTQTSDLQRSSGFTQDSGIYRNLEPNQETVIYKNQDLSQATDHQKNLGSSKDSGGHKNTGNVQDPG

SEQ ID NO: 793293 - protein, 103 aa, Homo sapiens
TNKRMNKETAGLLLRSRQSADRNCGRCTESQKDQPHREAQSIRHGAGPRAPRGGREAAAAPRGVRARPLSGSEVMLPGEGQMDSSVCRCGAREDPTPPVWHSP

SEQ ID NO: 793294 - protein, 75 aa, Homo sapiens
MSTCSTGMGCHWPVRPLLTRTSPELLRGLVVSVPSTRPRSPGFSSTYRPVPSWGECQPPWRLRPCRTHMLSSLMG

SEQ ID NO: 793295 - protein, 101 aa, Homo sapiens
EKACWSSVCFALVLNSSFCYVWPFRVEQVNNCMLVVERGGTGMSQPLGRGRGMSHCRDSLAAFLFLSRLLSPVTVGDNLKKPHHHWLLFSLLLIENSCFWR

SEQ ID NO: 793296 - protein, 75 aa, Homo sapiens
SLGTALEPPSVNCTLTIWSPAFSLKGLDWIFPVSPEINFKQVNKTIEEKCLEYFIRRQKSPGVKWKETCLYKQLK

SEQ ID NO: 793297 - protein, 123 aa, Homo sapiens
GNVSAHLGSLLQQEWRCVMSNRPSLSLRPGSGPTQPLLPESRGGSKRMALAFECSQAIQVQSILLLSSVPEASLLLLGQTHFSPQGLLSCSRVYTCCPSKAFTMIQAWPVAPASGTSHGLRST

SEQ ID NO: 793298 - protein, 48 aa, Homo sapiens
MAVTVPTSDALSFETWQAWYALALAAPRVPWTCCLGAALPSRRARLLR

SEQ ID NO: 793299 - protein, 138 aa, Homo sapiens
MMPHIQHLKGAHSKNLFLKDKKKKNYWLVTVLHDRQINLNELAKQLGVGSGNLRFADETAMLEKLKVGQGCATPLALFCDGGDVKFVLDSAFLEGGHEKVYFHPMTNAATMGLSPEDFLTFVKMTGHDPIILNFDKNN

SEQ ID NO: 793300 - protein, 72 aa, Homo sapiens
VYFKQFCRTCQKSYNPYRVEDITCQSCKQTRCSCPVKLRHVDPKRPHRQDLCGRCKGKRLSCDSTFSFKYII

SEQ ID NO: 793301 - protein, 162 aa, Homo sapiens
LPAISKAPSMDVQQETHKSQDCLGLLAPLASAAGVPSTAPMSGKKHRPPGPLFSSSDPLPATSSHSQDSAQVTSLIPAPFPAASMDAGMRRTRCGTSAPAAAAAAPPPSTLNPTLGSLLEWMEALHISGPQPQLQQVPRGQNQRSQTSRTSSCPKRNAISSP

SEQ ID NO: 793302 - protein, 122 aa, Homo sapiens
PTLTPCNLLNGKYYVSAVSDGNRAGFQEELTEHMILQGNQVTKSPQASPSLSVNQGSGGNPSTAALQWPMKYLFPTSSMSLIAFWLRKADSVSRATNMVSQLFNHSKFFFQPQLDYSYSEHV

SEQ ID NO: 793303 - protein, 104 aa, Homo sapiens
SCWAWNMFFSSLESSSFVFPLHLDGFSVPCLTWNNVPSVPCVSTKMSCPKEHAFQAPCPEPPTANGLAFPNLLGFLTHPIQYFPSRSSPPTCNDLCHVSFPSRL

SEQ ID NO: 793304 - protein, 90 aa, Homo sapiens
EDHSDVGAARGHTLSKVLKASAHWGQLAMGVCGRCHSKPLLTLGVPPSDSRGKESLGLVSGLGAAWATHIFERRFGGTAGDSLSHHLSPL

SEQ ID NO: 793305 - protein, 128 aa, Homo sapiens
PVPHQMLPYMNVGTLSRTELQLLNQLHCRRKRRHRTIFTDEQLEALENLFQETKYPDVGTREQLARKVHLREEKVEVWFKNRRAKWRRQKRSSSEESENAEKWNKTSSSKASPEKREEEGKSDLDSDS

SEQ ID NO: 793306 - protein, 99 aa, Homo sapiens
MGAGARSEKPSIFGAEKEGCLALDQRGFVTLVHICYSLGTSASLGVLGWLKESQIRVDKCSGFLHYVSKNHAASAFTLPVTKSQLFLLCEEGVCYIDPK

SEQ ID NO: 793307 - protein, 101 aa, Homo sapiens
AQETLGGLAPALENKFLVCPPELMVWWRICLKEFVPGKVQLHLTGKGEKRERGINLWPSASCLGICPFQPAPTPLEPKTMPCTCNQPATCEDHIKVFLSWL

SEQ ID NO: 793308 - protein, 137 aa, Homo sapiens
SPQVTSLMEGTSQVHGFGKPGLQRAPADTSLRQHRESVRWAPGPESLSSRPRLQERRLWALPASSLGRGQGCFGLCWAVENEGNFPCEDTRLANLPTHSSQGLSPYDSEGWALRNRHTGGCAGRERLTPGLTCPDPH

SEQ ID NO: 793309 - protein, 105 aa, Homo sapiens
PKNEEMFCDTEKFWKLKKKLDAQLNLSPEDTAFRNEDTAFPGEDTAFSEEDTAFPDEDIAFPGKDTPFSEEATAFSEEDTAFPDEDTAFPEEDTAFPDEVLASFR

SEQ ID NO: 793310 - protein, 86 aa, Homo sapiens
LWAAVWGREAGQMSRSPGEEAAPRGGQAGPQAWQDCLLPLGPGSAAWGWGTAMGQADLLPSLAPALRCGYPQVLEPLSAPFSPARE

SEQ ID NO: 793311 - protein, 134 aa, Homo sapiens
SSAGSRRTTGFGRRPRRPVDGRVGRGTGPTAAVSRFCPRRVRAMAASPGSGSANPRKFSEKIALHTQRQAEETRAFEQLMTDLTLSRVQFQKLQQLRLTQYHGGSLPNVSQLRSNASEFQVERNSSPCVDGLRQ

SEQ ID NO: 793312 - protein, 103 aa, Homo sapiens
NPWKRILAAYTIPFSLKLLSKAFSCNDCAAFFFPLVASFPGPLKEENLLNVPKPLPKQLWETKEVGEQYSAMFVVTECLYLEVIEKSCRGESKRNWGKRRRFV

SEQ ID NO: 793313 - protein, 661 aa, Homo sapiens
SSAGSRRTTGFGRRPRRPVDGRVGRGTGPTAAVSRFCPRRVRAMAASPGSGSANPRKFSEKIALHTQRQAEETRAFEQLMTDLTLSRVQFQKLQQLRLTQYHGGSLPNVSQLRSNASEFQPSFHQADNVRGTRHHGLVERPSRNRFHPLHRRSGDKPGRQFDGSAFGANYSSQPLDESWPRQQPPWKDEKHPGFRLTSALNRTNSDSALHTSALSTKPQDPYGGGGQSAWPAPYMGFCDGENNGHGEVASFPGPLKEENLLNVPKPLPKQLWETKEIQSLSGRPRSCDVGGGNAFPHNGQNLGLSPFLGTLNTGGSLPDLTNLHYSTPLPASLDTTDHHFGSMSVGNSVNNIPAAMTHLGIRSSSGLQSSRSNPSIQATLNKTVLSSSLNNHPQTSVPNASALHPSLRLFSLSNPSLSTTNLSGPSRRRQPPVSPLTLSPGPEAHQGFSRQLSSTSPLAPYPTSQMVSSDRSQLSFLPTEAQAQVSPPPPYPAPQELTQPLLQQPRAPEAPAQQPQAASSLPQSDFQLLPAQGSSLTNFFPDVGFDQQSMRPGPAFPQQVPLVQQGSRELQDSFHLRPSPYSNCGSLPNTILPDSSTSLFKDLNSALAGLPEVSLNVDTPFPLEEELQIEPLSLDGLNMLSDSSMGLLDPSVEETFRADRL

SEQ ID NO: 793314 - protein, 661 aa, Homo sapiens; identical to SEQ ID NO: 793313

SEQ ID NO: 793315 - protein, 661 aa, Homo sapiens; identical to SEQ ID NO: 793313

SEQ ID NO: 793316 - protein, 661 aa, Homo sapiens; identical to SEQ ID NO: 793313

SEQ ID NO: 793317 - protein, 470 aa, Homo sapiens
SSAGSRRTTGFGRRPRRPVDGRVGRGTGPTAAVSRFCPRRVRAMAASPGSGSANPRKFSEKIALHTQRQAEETRAFEQLMTDLTLSRVQFQKLQQLRLTQYHGGSLPNVSQLRSNASEFQPSFHQADNVRGTRHHGLVERPSRNRFHPLHRRSGDKPGRQFDGSAFGANYSSQPLDESWPRQQPPWKDEKHPGFRLTSALNRTNSDSALHTSALSTKPQDPYGGGGQSAWPAPYMGFCDGENNGHGEVASFPGPLKEENLLNVPKPLPKQLWETKEIQSLSGRPRSCDVGGGNAFPHNGQNLGLSPFLGTLNTGGSLPDLTNLHYSTPLPASLDTTDHHFGSMSVGNSVNNIPAAMTHLGIRSSSGLQSSRSNPSIQATLNKTVLSSSLNNHPQTSVPNASALHPSLRLFSLSNPSLSTTNLSKPGLACSGLLDQTDGILAAALNPSAGISQGTSVQLLPLSLILLYELL

SEQ ID NO: 793318 - protein, 437 aa, Homo sapiens
SSAGSRRTTGFGRRPRRPVDGRVGRGTGPTAAVSRFCPRRVRAMAASPGSGSANPRKFSEKIALHTQRQAEETRAFEQLMTDLTLSRVQFQKLQQLRLTQYHGGSLPNVSQLRSNASEFQPSFHQADNVRGTRHHGLVERPSRNRFHPLHRRSGDKPGRQFDGSAFGANYSSQPLDESWPRQQPPWKDEKHPGFRLTSALNRTNSDSALHTSALSTKPQDPYGGGGQSAWPAPYMGFCDGENNGHGEVASFPGPLKEENLLNVPKPLPKQLWETKEIQSLSGRPRSCDVGGGNAFPHNGQNLGLSPFLGTLNTGGSLPDLTNLHYSTPLPASLDTTDHHFGSMSVGNSVNNIPAAMTHLGIRSSSGLQSSRSNPSIQATLNKTVLSSSLNNHPQTSVPNASALHPSLRLFSLSNPSLSRKSNSSLRRRSMCSRQPGL

SEQ ID NO: 793319 - protein, 315 aa, Homo sapiens
SSAGSRRTTGFGRRPRRPVDGRVGRGTGPTAAVSRFCPRRVRAMAASPGSGSANPRKFSEKIALHTQRQAEETRAFEQLMTDLTLSRVQFQKLQQLRLTQYHGGSLPNVSQLRSNASEFQPSFHQADNVRGTRHHGLVERPSRNRFHPLHRRSGDKPGRQFDGSAFGANYSSQPLDESWPRQQPPWKDEKHPGFRLTSALNRTNSDSALHTSALSTKPQDPYGGGGQSAWPAPYMGFCDGENNGHGEVASFPGPLKEENLLNVPKPLPKQLWETKEVGEQYSAMFVVTECLYLEVIEKSCRGESKRNWGKRRRFV

SEQ ID NO: 793320 - protein, 91 aa, Homo sapiens
GRRGARKTLALGYLFPEHTLALGPEISPCRGSHELRGQQQGWPHHPSATSSPAAQPAISPLTASVRGPCKTTKRKRRDHLRYDFKSSHWVV

SEQ ID NO: 793321 - protein, 101 aa, Homo sapiens
VIDVATSGVFSVFFLERYGEMWPCLVSLPEPHIGWIAVGGADFVATEPQTPLLPTGVIYKACRMPVRQWLQSGHSHWLAAPGVAHAENRSVPPSQQPVEIS

SEQ ID NO: 793322 - protein, 100 aa, Homo sapiens
RGLLQGWGLLYPLAPDKSQGTDVTHYEQAVKLWQGWSCPRLWHHPRGLELTPRYRLFRTPRPQAGASGEAFGHSESWHSQRVTQHEAPPPPPSTVSCEQS

SEQ ID NO: 793323 - protein, 69 aa, Homo sapiens
RLSSLAGGLEHRYFRDQLLEVQVLGLASSQALKPQVLQTHTTTCSRRALVLGEGGGELRECFFPSGQEN

SEQ ID NO: 793324 - protein, 89 aa, Homo sapiens
EGRCCQIEELGWNMPAHAGFPSDTREACIESPGHGPSRSSADSPFHTVGVRLRDSVLLRGTHRTRLTCAPRAAPSRNSRRSWGKEFPSG

SEQ ID NO: 793325 - protein, 74 aa, Homo sapiens
ERRWPGAPRERRGGRQRRRRRRRLPGCDFARGGHPGYLNGVGGAGSGLLGRAGGRRCTGAGRRMRQERRAAPRG

SEQ ID NO: 793326 - protein, 621 aa, Homo sapiens
RHHVHASPQLQELGGIPHPAQLGDAPGGRPPAPGGEGSSRPQSTPGAAGGRVKAGVPGRNVEGRRGLGPVALGWGPQLAPLGALGGGSSRLWGGEGAGWAGSGARGGGPGAAGSSPRGCLSAARRAEDSAGRARLGCRPAPSPRPCPGPRAPAAACAPQPRSPAPAAASSMGNLLGGVSFREPTTVEDCDSTWQTDSEPEPEEPGPGGGSEGPGQESEQPAQPPEQAGGRPGASPAPDEDAEAAGAEQGGDSTEATAKPKRSFYAARDLYKYRHQYPNFKDIRYQNDLSNLRFYKNKIPFKPDGVYIEEVLSKWKGDYEKLEHNHTYIQWLFPLREQGLNFYAKELTTYEIEEFKKTKEAIRRFLLAYKMMLEFFGIKLTDKTGNVARAVNWQERFQHLNESQHNYLRITRILKSLGELGYESFKSPLVKFILHEALVENTIPNIKQSALEYFVYTIRDRRERRKLLRFAQKHYTPSENFIWGPPRKEQSEGSKAQKMSSPLASSHNSQTSMHKKAKDSKNSSSAVHLNSKTAEDKKVAPKEPVEETDRPSPEPSNEAAKPRNTEKDSNAENMNSQPEKTVTTPTEKKESVSPENNEEGGNDNQDNENPGNTNCHDVVLVQ

SEQ ID NO: 793327 - protein, 334 aa, Homo sapiens
RHEEKFFIISFPFTENFFNVNTIWPKWKGDYEKLEHNHTYIQWLFPLREQGLNFYAKELTTYEIEEFKKTKEAIRRFLLAYKMMLEFFGIKLTDKTGNVARAVNWQERFQHLNESQHNYLRITRILKSLGELGYESFKSPLVKFILHEALVENTIPNIKQSALEYFVYTIRDRRERRKLLRFAQKHYTPSENFIWGPPRKEQSEGSKAQKMSSPLASSHNSQTSMHKKAKDSKNSSSAVHLNSKTAEDKKVAPKEPVEETDRPSPEPSNEAAKPRNTEKDSNAENMNSQPEKTVTTPTEKKESVSPENNEEGGNDNQDNENPGNTNCHDVVLVQ

SEQ ID NO: 793328 - protein, 190 aa, Homo sapiens
MPPLHQLAIPSLSLSLGLPIPSDTTILKLGPLNNPSLTYKCSSERKSHTFLTLKRKEQSEGSKAQKMSSPLASSHNSQTSMHKKAKDSKNSSSAVHLNSKTAEDKKVAPKEPVEETDRPSPEPSNEAAKPRNTEKDSNAENMNSQPEKTVTTPTEKKESVSPENNEEGGNDNQDNENPGNTNCHDVVLVQ

SEQ ID NO: 793329 - protein, 166 aa, Homo sapiens
MGNLLGGVSFREPTTVEDCDSTWQTDSEPEPEEPGPGGGSEGPGQESEQPAQPPEQAGGRPGASPAPDEDAEAAGAEQVRGPAVASGRAGAPRHPRGASAKPPSRSEARGARWLLAAATRPLRAAADLSPGGARGPAGAQSAGPSHCRPGAWPRARRGSPSRQNPT

SEQ ID NO: 793330 - protein, 252 aa, Homo sapiens
MMLEFFGIKLTDKTGNVARAVNWQERFQHLNESQHNYLRITRILKSLGELGYESFKSPLVKFILHEALVENTIPNIKQSALEYFVYTIRDRRERRKLLRFAQKHYTPSENFIWGPPRKEQSEGSKAQKMSSPLASSHNSQTSMHKKAKDSKNSSSAVHLNSKTAEDKKVAPKEPVEETDRPSPEPSNEAAKPRNTEKDSNAENMNSQPEKTVTTPTEKKESVSPENNEEGGNDNQDNENPGNTNCHDVVLVQ

SEQ ID NO: 793331 - protein, 621 aa, Homo sapiens; identical to SEQ ID NO: 793326

SEQ ID NO: 793332 - protein, 106 aa, Homo sapiens
IRQAILLEPIQIKLPNTERCFLHPARGAHSIFPCLTSWCEPWALLTMAQDSCPSESTRSIHVDRLPRRNSASLSLSAFPVSAGALINGEAWVRMGQVPIPKAPGRA

SEQ ID NO: 793333 - protein, 33 aa, Homo sapiens
FRRMVSISGGWRFPPHGNVAGAWSASSWLSVEG

SEQ ID NO: 793334 - protein, 119 aa, Homo sapiens
MGITPRQKCLLGDRHWLGWDQVASFCSPAQRTGSSRSALFFLDRGNENEYFPLKLTCFRILSGREHCSFLVLSHFQDPPTPACPHFELSSSAPASPHSSPRWLLSAHPDSRPHCAFFLR

SEQ ID NO: 793335 - protein, 169 aa, Homo sapiens
MEVFPAHISSYLRRLLQARTLLRGGYSPLIQTPALTAPSSCDDRGGGGRPPLASFQRTFKPEPQSQSPRAVEKSGAPRGPHRKLRAFPWKGREQGRPSWPLSPLLQGRRPLSERAALLVPPEVIVRVHFLGETEVILSSPPFLLFSGGRRLLDPGSLPASREIREGLYC

SEQ ID NO: 793336 - protein, 110 aa, Homo sapiens
EPFLHSVCFLRTPVFTKGVGKGREHRTYSGIQVTFYICLELGERLTNDSAGLTATANQADASNEEDLPRPGGCLLPPSGPWHISGPPALLSERDDGQRRILRDRACLQIL

SEQ ID NO: 793337 - protein, 102 aa, Homo sapiens
FTLLPGLECSGTISARCKLCLRGSSKSPASASRVIGTMGACHHAQLIFVFLVETGFHHVGFGQDGLELLTSSDLPASASQSAEMTGVSHCAWLDIIHFFPLS

SEQ ID NO: 793338 - protein, 69 aa, Homo sapiens
LLLVDEIIWSVLDFLPYSSFNGGRGICVLTVADIFFLSRWASSGTSSLLSSLCCSKEPSGKGARLSPHQ

SEQ ID NO: 793339 - protein, 71 aa, Homo sapiens
CNESTCTVKERDMQSPGLVQGSQMASVLKGKQAPSIRRWVADGRVTLGWERSLAAMSCQKARSSVVRNIRG

SEQ ID NO: 793340 - protein, 111 aa, Homo sapiens
NKNQNSSLYLHAKRTHDTNSTVISIKRVPYHTSGRIFVKDISKVTLTFLLFFVMVSNVNFFPYHLILEEIYFYSLLNREGNQMVSHLKLLDIILLLCSSKNIQQSQTEIIT

SEQ ID NO: 793341 - protein, 81 aa, Homo sapiens
EQDGERQKPNSRICWVLQTVAGTSLPGRCPSSVCSSGPQGGRKEPQRVRTTALTDARAGLHSVNLTKRTGCAGMFFFHFLH

SEQ ID NO: 793342 - protein, 115 aa, Homo sapiens
RPSKVAKWERLHRVGCRKTLTLAPAQPLSSRVALGDTCPWSVSLPVNLGTWKPCSRRAHPQEVIRVLLQVRNLAAVCENLRKGRGKRLWQEVRRELVIPWAGCHELGWKPQDECK

SEQ ID NO: 793343 - protein, 104 aa, Homo sapiens
SVFHPGIMPLVASPGLRARVSPASRQNQEGLPQSWARSGRWRAPLHRGLAEHSGKCKLPWAMPRVGQEYPLARNQEASKGNASMVTRRDGEAAPQGSSGAQKGA

SEQ ID NO: 793344 - protein, 116 aa, Homo sapiens
LKYSLPSQIPSPFLTKHRITKNRTTQPQYHLLRQFQPTFSAKAVSSLSGCIPCRQSELLARKQSSLLIFAVLKPIAEAMLCPSPDGSSVITKPSVGLLLCSGATGRERLNAFHPGP

SEQ ID NO: 793345 - protein, 107 aa, Homo sapiens
LTFDSTSAYSLTYALSRKWTLAQITPLLSTSIPRGGPTPFQLGSELGKFRPRVDFNSATCQRVDPNMPCVSPVGILGFPGSMLRRLGPPPDFFKALPKSQLLQSQEP

SEQ ID NO: 793346 - protein, 137 aa, Homo sapiens [sequence omitted]

SEQ ID NO: 793347 - protein, 101 aa, Homo sapiens
LLLPRLECNGTISAHCNLRLLGSNNSPTSASQVAVITGTCHHAQLIFIFLTEIRFHHIGQAGLKLLTSGDPPASASQSAGITGMSHRAWPSPRIETKLILY

SEQ ID NO: 793348 - protein, 83 aa, Homo sapiens
HRLIRGCSDYAADADYAARSDYAARSDYAARSDYAARSDYAARSHYAARSDTRLSTAPLELTTFPGLPRYLWLAAAILHRAGL

SEQ ID NO: 793349 - protein, 51 aa, Homo sapiens
MGCAGSFSKAWCALACARDPGRGLSANRGFAMWPARAYLRAVTTRLEAWAA

SEQ ID NO: 793350 - protein, 120 aa, Homo sapiens
RKGRREDLSPHLILPQWEWPLHVQLVPGSPNPSSSWEEGSGSSQQRAPGPALPCGRQGPPPKPLFLPINVFTLVLPQVRGCDNGIPSLHGGQELNFSLQAMKVQGLHFINGCYVIKNDKM

SEQ ID NO: 793351 - protein, 216 aa, Homo sapiens
QAAVPSGQCPPCRISRIWKAAAARNKKSERARLSRSSARRVPAPCRAWEPASHAINPLAGSPRSSRATRKTVSQPPWGPTDIVLTPCTTLLRGHTGPCSIESSGSPISAGDEGGRMTEPWLALGTSWTLPLQDRELGPEELDELQAAFEEFDTDRDGYISHRELGDCMRTLGYMPTEMELLEVSQHIKMRMGGRVDFEEFVELIGPKLREETAHML

SEQ ID NO: 793352 - protein, 101 aa, Homo sapiens
MTEPWLALGTSWTLPLQDRELGPEELDELQAAFEEFDTDRDGYISHRELGDCMRTLGYMPTEMELLEVSQHIKMRMGGRVDFEEFVELIGPKLREETAHML

SEQ ID NO: 793353 - protein, 78 aa, Homo sapiens
QAAVPSGQCPPCRISRIWKAAAARNKKSERARLSRSSARRVPAPCRAWEPASHAINPLAGSPRSSRATRKTVSQPPWG

SEQ ID NO: 793354 - protein, 485 aa, Homo sapiens
PLPAAPEPLRPAARSPGTGGAMDRGQVLEQLLPELTGLLSLLDHEYLSDTTLEKKMAVASILQSLQPLPAKEVSYLYVNTADLHSGPSFVESLFEEFDCDLSDLRDMPEDDGEPSKGASPELAKSPRLRNAADLPPPLPNKPPPEDYYEEALPLGPGKSPEYISSHTDGPWADCTFWLWCLDQMAAAPHTRSVDGYYEDADSSYPATRVNGELKSSYNDSDAMSSSYESYDEEEEEGKSPQPRHQWPSEEASMHLVRECRICAFLLRKKRFGQWAKQLTVIREDQLLCYKSSKDRQPHLRLALDTCSIIYVPKDSRHKRHELRFTQGATEVLVLALQSREQAEEWLKVIREVSKPVGGAEGVEVPRSPVLLCKLDLDKRLSQEKQTSDSDSVGVGDNCSTLGRRETCDHGKGKKSSLAELKGSMSRAAGRKITRIIGFSKKKTLADDLQTSSTEEEVPCCGYLNVWVTRREDAVPPDCHHCLTLC

SEQ ID NO: 793355 - protein, 88 aa, Homo sapiens
FTLPPAFCELLPPSPSASLSLPCSAPLALFFVPLQAADLPPPLPNKPPPEDYYEEALPLGPGKSPEYISSHSKFWSSWWGWGLPVPEK

SEQ ID NO: 793356 - protein, 94 aa, Homo sapiens
MEVKKIPVEEGLCTTIPCAFEFPKEPPSNSMIMHYWLNKNISSLVATNKPNATIGDNTKDKFYMTGNLDEEDCTLLIHDILKGNSIIYLFYADL

SEQ ID NO: 793357 - protein, 59 aa, Homo sapiens
VEVQGVAHEDAVQGIANEDAAHGITNEVAAHGIANEDAAQGIANEDAAQGIAHEDAVQG

SEQ ID NO: 793358 - protein, 70 aa, Homo sapiens
LILGTCQYVTLCGKRDFADVIKFKDLEMGRVPWTIQVGPISSQVLKIGELFLGCGKPERWQHEKNFAPYC

SEQ ID NO: 793359 - protein, 99 aa, Homo sapiens
EIRTFWNLNMRGLGGEGGTEEESSLGQAGGKLKTAAWPSWVAEVGAAGALADPGGQKSGSFLPSQQLQCIPGPGLYAGEASKDPVLRKLPFQCGRTHNP

SEQ ID NO: 793360 - protein, 99 aa, Homo sapiens; identical to SEQ ID NO: 793359

SEQ ID NO: 793361 - protein, 127 aa, Homo sapiens
TSVQISANVGWRTVYGHESKSFLMYLFNRGSQVDPAPAFFLPGLCLAAGSGNNPKGFISFRCLWPLLHNPDAFALTLHHIPLRVLFLMVPIGANTVDSVLSHHLAPTLKSKPELSPCILLAQSPPSV

SEQ ID NO: 793362 - protein, 103 aa, Homo sapiens
MSSVFWIYVQPRKQRLWDFNIEVSSKNVQRLIALREINLGPFVFSKHVLPSRNTCYGWFHPQDCIFLHWPQVTACCSQLISKDPQNNPIHAFPSPATPVIELP

SEQ ID NO: 793363 - protein, 87 aa, Homo sapiens
SSWTRGQRACSEPSPWTCLLCSVHAMEEVVKEVVGHAKETGEKAIAEAIKKAQESGDKKMKEVTETVTNTVTNAITHAAESLGKLGQ

SEQ ID NO: 793364 - protein, 426 aa, Homo sapiens
MAGLGFWGHPAGPLLLLLLLVLPPRALPEGPLVFVALVFRHGDRAPLASYPMDPHKEVASTLWPRGLGQLTTEGVRQQLELGRFLRSRYEAFLSPEYRREEVYIRSTDFDRTLESAQANLAGLFPEAAPGSPEARWRPIPVHTVPVAEDKLLRFPMRSCPRYHELLREATEAAEYQEALEGWTGFLSRLENFTGLSLVGEPLRRAWKVLDTLMCQQAHGLPLPAWASPDVLRTLAQISALDIGAHVGPPRAAEKAQLTGGILLNAILANFSRVQRLGLPLKMVMYSAHDSTLLALQGALGLYDGHTPPYAACLGFEFRKHLGNPAKDGGNVTVSLFYRNDSAHLPLPLSLPGCPAPCPLGRFYQLTAPARPPAHGVSCHGPYEAAIPPAPVVPLLAGAVAVLVALSLGLGLLAWRPGCLRALGGPV

SEQ ID NO: 793365 - protein, 79 aa, Homo sapiens
SRVTFTLQQSRWSTLVKDQEYYQFSDEERNIFGHQQSAFDHPQSQVFHRCLEKYFIQRTHMSSLNVSFLGAVGERNFKM

SEQ ID NO: 793366 - protein, 201 aa, Homo sapiens
SNFLFGGHTVFLQHLEPGAGFSDPLLWSTSAADDQSGSVVILVGITLLTTLKGLNWVPCYREGLLQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 793367 - protein, 285 aa, Homo sapiens
SNFLFGGHTVFLQHLEPGAGFSDPLLWSTSAADDQSGSVVILVGITLLTTLKGLNWVPCYREGLLQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESTSPSGMLPPWQMTQPLENYLDMEYFATIGIATPAQDCAPSSFDTRLLPPRWVPSVYCSSLACTSHIRFNPEDSSTYQSTIETVSITLRHRQHDTASSDTTLSRLEPSLTPIRSSA

SEQ ID NO: 793368 - protein, 72 aa, Homo sapiens
VYHPAPITAESVSQLHFYSPFLQSEGSCISGFQGMNLPTESGELWILGDVFIRQYFTVFDRANNQVGLAPVA

SEQ ID NO: 793369 - protein, 109 aa, Homo sapiens
QTIQTAQGEVMGSINKLYLHPPVSSCSSSCYHKRHTVICGKINQQTTSGCGHTKELPQTPLPNINPSFCKFGAASSLTVKGAAGRLTKTCLPDFESIFPFSRVTSHQPP

SEQ ID NO: 793370 - protein, 122 aa, Homo sapiens
YNQCAVVGNGGILNKSLCGTEIDKSDFVFRCNLPPTTGDVSKDVGSKTNLVTINPSIITLKYGNLKEKKALFLEDIATYGDAFFLLPAFSFRANTGTSFKVYYTLEESKASFSPSAKQKEEL

SEQ ID NO: 793371 - protein, 92 aa, Homo sapiens
THTEACGPILTGTCGLGTGGAGKTPPTFGPWKAPLPMSLFAGSPDPTWGSHGSPAQPGVGMGHRPFLFSLYRQILTTHPPSPDTFYLITCHC

SEQ ID NO: 793372 - protein, 76 aa, Homo sapiens
MRLSLLRIPDVREPVWASRHLLALPQGGTTLQGALLVQHAGALAPINPRMRHSGQLGIEPVASQRVLPRHVLALFY

SEQ ID NO: 793373 - protein, 341 aa, Homo sapiens
MEVTRQHPRHPYPKVGSRIPSNRKCHSPPPPPSGTLTGAECGGGRGRERRGGGTRHTHHAENCFTAFLKVAEGAAAAAAKETQDRERRSGGDGGGNSEGARNSPSARQGRGRRGRGASRRTPRTVTAATAGRARARALPSLRPREPEKDSHPRSRRRPLPHFRRLLATAGVGAGMRAGVVVQFNPSGAARRLERLEKPPTPAAFVSPAGNTQPAQLVPAGSFRDSSRLRPHGGHRPRELLEGFFSLCLLDGRREEGTAPLLGTSSVERSPFNRQGLNFHASCQCALDFILLRIGPHPPWCSDCEFPNPGFCARTLALPVRWFLADNPSSGWVRGYIYVAFF

SEQ ID NO: 793374 - protein, 363 aa, Homo sapiens
MEVTRQHPRHPYPKVGSRIPSNRKCHSPPPPPSGTLTGAECGGGRGRERRGGGTRHTHHAENCFTAFLKVFKMQFLQPENSHPFTSPSPHPAPHPHRGLRWAVSPRRPRPHAPRRAAPGGGVPDAAQLGMLRYLYVVVLAVIGHPFQICVAVEEGPAAPRDFLFQQHLQLRHLHILLLLLLITGRRGSGGRSAKETQDRERRSGGDGGGNSEGARNSPSARQEEGATGAGREPTDSEDGHRGDGRPGARTRAPFPPPPGARKRFPPSLAPPAPPPLPASPSDGGGRGRDARGSWWCSLTLPAPPAAWSGWRSPRLRRPLLARPGTHNLLSWFLPGPSGTHLGSVPMEVIGLGNFSKAFLPLLA

SEQ ID NO: 793375 - protein, 141 aa, Homo sapiens
ARAGEAEKKHQAYKCMLTCSRNRLIAWAFPWDPCLQASLIHAFLGSPHQPLLKTLQGFSCQAPCRTSQALWDSSSRASPASFATVTHSPALIHQLAHHRRSYKISFETLILYIYVHPPKLIKQESRQVVIDKYVIKCLQNV

SEQ ID NO: 793376 - protein, 119 aa, Homo sapiens
VHAPPVQPISLKINEYIQVQIRSQDKIIFCFTYEQKQICLNLGTRYKFVIPEVLSEMKKKTILEAEPGPTAQKIRVLLGKMNRLLNYATTPDLENFIEAVSISLMDNKYLKKMLSKLWF

SEQ ID NO: 793377 - protein, 112 aa, Homo sapiens
NIIDMWKWLFDYNNCIMTSDFILQPTVISQLPLQCERCYQRFCIPYGLKLLRRNIFLCLTKAYEENVTKIFIKGQVRWLTPVIPALWEAKAGRSRGQEFKTSLANIGKPHLY

SEQ ID NO: 793378 - protein, 140 aa, Homo sapiens
YLHFAQERIEREQFRVSQNQITKDLSPNTHTCNYSMLLPGTGLYLEVANFTTTEDLRKPLACLHPTHTQSIKNNRNILCMELCYHPIALRTTGLGHISKCTLNETIPPYLLTRLTFDPHFTEQVSKTPAEKITYPRSQTL

SEQ ID NO: 793379 - protein, 149 aa, Homo sapiens
YVGITSRTTKMTIKESLLSAGSTAGMGLSTHCNVICTGKHHIGHINSGKIVVEKLPQLGVVVTPVIPELCKAVRLVDPLRPRVRDQPEQNRETPPMQKIQKLARRGGALLLTQLFRKLRQKDHKKSRPQWGIITSLHSTMGDRGETLLQ

SEQ ID NO: 793380 - protein, 129 aa, Homo sapiens
PLSSCSPGTLQPEQDCTCSLPGASSLSGLALASDALSFGFEICWVRFTRALAFFGLGILNSFFKQAVDQLYLLTSGCISCSPAPDLLFPWFILSLCCSTSSSGFQRNSEWKPSFLTLTYFRMSLFYPNS

SEQ ID NO: 793381 - protein, 155 aa, Homo sapiens
MRWLYTWVTRAHTEPSTRPTSFPYSSARPVNSENAQIPAGPGLPGRAGRTGLRGAARGRGRGRGRRKSQESLWGLQGRGSGCGCGVGICISRAGPADARGLQETRGPGLGVQEVIREGLGRPRGQGSSREAAPRRSQEGRRATPGPATFQRLGTA

SEQ ID NO: 793382 - protein, 192 aa, Homo sapiens
MGEDTLPDQGPPYERWSPTSPRPYMRNLPGRCNKSETDPLILSQVAFTPEAMDGLGGRGKWGQASAAAPEGRSLANGTPPMGAASKVPAVQSVCARGMAGQLAPLQVTEGSTSSGTESSESDSEMLIPGSQPLIFGNPAVLRSPSLLRSRGSLGGLRLMRNRRRMSEEARSQVFSPSNLGSRDQGFPKDHLF

SEQ ID NO: 793383 - protein, 85 aa, Homo sapiens
SRLALTPLTEFPLSILWGAASQEALPRPGCSFFPRKPPGDAPGGPATPWRRRVIVLSGILQDHHETLNWITLPRPALLTEQLEPI

SEQ ID NO: 793384 - protein, 393 aa, Homo sapiens
AGRVRPRGLGRDRCMGDSRRRSLGNQPSSEAAGRSEREQDGDPRGLQSSVYESRRVTDPERQDLDNAELGPEDPEEELPPEEVAGEEFPETLDPKEALSELERVLDKDLEEDIPEISRLSISQKLPSTTMTKARKRRRRRRLMELAEPKINWQVLKDRKGRCGKGYAWISPCKMSLHFCLCWPSVYWTERFLEDTTLTITVPAVSRRVEELSRPKRFYLEYYNNNRTTPVWPIPRSSLEYRASSRLKELAAPKIRDNFWSMPMSEVSQVSRAAQMAVPSSRILQLSKPKAPATLLEEWDPVPKPKPHVSDHNRLLHLARPKAQSDKCVPDRDPRWEVLDVTKKVVASPRIISLAKPKVRKGLNEGYDRRPLASMSLPPPKASPEKCDQPRPGL

SEQ ID NO: 793385 - protein, 169 aa, Homo sapiens
QSFSFQRDNPGTSSSQCCTQKENLRPSSPHRSTQWNNPRNSSPHRTNKDIPWASFPLRPTQSDGPRTSSPSRSKQSEVPWASIALRPTQGDRPQTSSPSRPAQHDPPQSSFGPTQYNLPSRATSSSHNPGHQSTSRTSSPVYPAAYGAPLTSPEPSQPPCAVCIGHRDA

SEQ ID NO: 793386 - protein, 37 aa, Homo sapiens
MILSDDQPAAITGCLLSNRLHVFCYEIQKKHDVLAES

SEQ ID NO: 793387 - protein, 103 aa, Homo sapiens [sequence omitted]

SEQ ID NO: 793388 - protein, 261 aa, Homo sapiens [sequence omitted]

SEQ ID NO: 793389 - protein, 194 aa, Homo sapiens
MTVFRQENVDDYYDTGEELGSGQFAVVKKCREKSTGLQYAAKFIKKRRTKSSRRGVSREDIEREVSILKEIQHPNVITLHEVYENKTDVILILELWVPPGPGWGEGVVGVSWHLRSSWTTPQRARERDQELVLLYEVCENNAVLPDLKPSCRDLEQTLKSNSHHCGSTQFARGSPSLAVHHFLGFIFAVSTSVF

SEQ ID NO: 793390 - protein, 79 aa, Homo sapiens
WYGPGLWECDCMRLYVSAACPFSLVFIHSHSDEQWWRQCPELWQPPCSREAPVGMTVKRTTEMPAPGPTAAAPASRLRV

SEQ ID NO: 793391 - protein, 70 aa, Homo sapiens
MLASFILHASDDPVAPQCQAPLALLRTSVTMFSPTACCQSDGGDRTAVPDGGGNAQSCGSHLAAVKHQWE

SEQ ID NO: 793392 - protein, 99 aa, Homo sapiens
KGFHNATGVVWLVAVIVGSPMWHVQQLEIKYDFLYEKEHICCLEEWTSPVHQKIYTTFILVILFLLPLMEEETSCHYDGDSGGSLCCVLGTIPCCPYDD

SEQ ID NO: 793393 - protein, 112 aa, Homo sapiens
LSPTECCVCQKLKSWIRAKFVVPLGGASALLCAAWVRTEPPNLKSWIRAKFVVPLGGASALLCAAWVRTEPPNLELHLSGPIPVLSSEKRKSCKENRRHLFCHCHALVLAQT

SEQ ID NO: 793394 - protein, 114 aa, Homo sapiens
RRNILSASRILADSPQPRVPMATAWRLMVTSFSTSVERFVYSAILSSAYDSTGHALHCKLSDLPDICNFGCCHWPRLQTFSVLYFDISLCPSLPTSFSHSYPFTHTTSELFCGD

SEQ ID NO: 793395 - protein, 251 aa, Homo sapiens
RDQAAGLEESQRRQAQSRRASPIGGHIRRASWRRKGSWCQGSGGSGLRERDEEEEAGPGSGRRQRELNRRKYQARGRRCREIEQVNERVLNRLHQVQRITRRLQQERRFLMRVLDSYGDDYRASQFTIVLEDEGSQGTDAPTPGNAENEPPEKETLSPPRRTPAPPEPGSPAPGEGPSGRKRRRVPRDGRRAGNALTPELAPVQIKVEQHFVFQTDKALDPSSVPPAPDKLVPYIDLEQSQPLIFVMPHHL

SEQ ID NO: 793396 - protein, 121 aa, Homo sapiens
MSAAGPFAPPGDLRRVACPAPEPRLEAAVGPGLLRRHPLPPRRVGLCQPRVSRGRGRGSGLSGRRKRNGASPRARRDSLSCGTCTQDSAHTCSSLSCWWGERRSCASVTPRRQWGLVNPQT

SEQ ID NO: 793397 - protein, 220 aa, Homo sapiens
MMTEKHEDHCLKSCSGHSYIRKNWLGCIVFPFSALLQQSEFLDQTEVLQRAQIFKKNCKAMFPNRRIVTTVFNDEGIQFLVTRYIKALNPPQQLLDIFLHNSNATFDLIARFVSLIPFVPNTPDENDGSDIWMTSEHCISLAIGNKEEHAILLCNFFLYFGKKALVLLGTSVLEGHVAYVVTQETNEYLLWNPSTGQCYKQFDPFCPLKSVDCLFDDRNV

SEQ ID NO: 793398 - protein, 151 aa, Homo sapiens
MKRSFKLYQSFPLCSPGHDYSFSSLSKIKDNIYINIFDEMMTEKHEDHCLKSCSGHSYIRKNWLGCIVFPFSALLQQSEFLDQTEVLQRAQIFKKNCKAMFPNRRIVTTVFNDEGIQFLVTRYIKALNPPQQLLDIFLHNSNATFVSYYYF

SEQ ID NO: 793399 - protein, 112 aa, Homo sapiens
MPCLISGSFTGFRSPFLPLVPTKIQKGPDNTKARKGTTVTLTAEILGEPAPDVGWTKDGEDIEEDDRVFFEIGSTTTTLTIRRATPQDSGKYEVYVENSLGMDQSFARVDVA

SEQ ID NO: 793400 - protein, 175 aa, Homo sapiens
MPCLISGSFTGFRSPFLPLVPTKIQKGPDNTKARKGTTVTLTAEILGEPAPDVGWTKDGEDIEEDDRRGPGPAARPGPGAGTWVGLSPEIWLECRGRGLGSEEQSWLRSPAQCARVLTTAPPSSPPPFRRVFFEIGSTTTTLTIRRATPQDSGKYEVYVENSLGMDQSFARVDVA

SEQ ID NO: 793401 - protein, 90 aa, Homo sapiens
TYAQENMPLAKELLHPSPEEEKRKHKKKRLVQSPNSYFMDVKCPGCYKITTVFSHAQTVVLCVGCSTVLCQPTGGKARLTEGCSFRRKQH

SEQ ID NO: 793402 - protein, 595 aa, Homo sapiens
MKFFSYILVYRRFLFVVFTVLVLLPLPIVLHTKEAECAYTLFVVATFWLTEALPLSVTALLPSLMLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKNSGMRTKYRTKKGHVTRKLTCLCIAYSSTIGGLTTITGTSTNLIFAEYFNTRYPDCRCLNFGSWFTFSFPAALIILLLSWIWLQWLFLGFNFKEMFKCGKTKTVQQKACAEVIKQEYQKLGPIRYQEIVTLVLFIIMALLWFSRDPGFVPGWSALFSEYPGFATDSTVALLIGLLFFLIPAKTLTKTTPTGEIVAFDYSPLITWKEFQSFMPWDIAILVGGGFALADGCEESGLSKWIGNKLSPLGSLPAWLIILISSLMVTSLTEVASNPATITLFLPILSPLAEAIHVNPLYILIPSTLCTSFAFLLPVANPPNAIVFSYGHLKVIDMVKAGLGVNIVGVAVVMLGICTWIVPMFDLYTYPSWAPAMSNETMP

SEQ ID NO: 793403 - protein, 223 aa, Homo sapiens
MKFFSYILVYRRFLFVVFTVLVLLPLPIVLHTKEAECAYTLFVVATFWLTEALPLSVTALLPSLMLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKGTV

SEQ ID NO: 793404 - protein, 254 aa, Homo sapiens
MKFFSYILVYRRFLFVVFTVLVLLPLPIVLHTKEAECAYTLFVVATFWLTEALPLSVTALLPSLMLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKHWKLAVQDGSPSPSVHSVSQLAAQGKEKVEGICT

SEQ ID NO: 793405 - protein, 290 aa, Homo sapiens
MKFFSYILVYRRFLFVVFTVLVLLPLPIVLHTKEAECAYTLFVVATFWLTEALPLSVTALLPSLMLPMFGIMPSKKVASAYFKDFHLLLIGVICLATSIEKWNLHKRIALKMVMMVGVNPAWLTLGFMSSTAFLSMWLSNTSTAAMVMPIAEAVVQQIINAEAEVEATQMTYFNGSTNHGLEIDESVNGHEINERKEKTKPVPGYNNDTGKISSKVELEKNSGMRTKYRTKKGHVTRKLTCLCIAYSSTIGGLTTITGTSTNLIFAEYFNTFHPHRRGDRTRHVHQEAEI

SEQ ID NO: 793406 - protein, 99 aa, Homo sapiens
SGSLPGELALLAVLPVLLLQITVGLVFLCLQYRLRGKLRAEIENLHRTFDPHFLRVPCWKITLFVIVPVLGPLVALIICYNWLHRRLAGQFLEELRNPF

SEQ ID NO: 793407 - protein, 147 aa, Homo sapiens
SGSLPGELALLAVLPVLLLQITVGLVFLCLQYRLRGKLRAEIENLHRTFDPHFLRVPCWKITLFVIVPVLGPLVALIICYNWLHRRLAGQFLEELRKFSSLCYKQRIKSQERETEATRGRGGLLRDHIPRGKEELESLGGGKTPPGR

SEQ ID NO: 793408 - protein, 69 aa, Homo sapiens
HDEAHVPSQQVKEEQPEQEGWFGTRTPESQTYAHPPGRGFTLSSPSPHSVPLHPAKPPCLDQCPLLDET

SEQ ID NO: 793409 - protein, 357 aa, Homo sapiens
MMARLLRTSFALLFLGLFGVLGAATISCRNEEGKAVDWFTFYKLPKRQNKESGETGLEYLYLDSTTRSWRKSEQLMNDTKSVLGRTLQQLYEAYASKSNNTAYLIYNDGVPKPVNYSRKYGHTKGLLLWNRVQGFWLIHSIPQFPPIPEEGYDYPPTGRRNGQSGICITFKYNQYEAIDSQLLVCNPNVYSCSIPATFHQELIHMPQLCTRASSSEIPGRLLTTLQSAQGQKFLHFAKSDSFLDDIFAAWMAQRLKTHLLTETWQRKRQELPSNCSLPYHVYNIKAIKLSRHSYFSSYQDHAKWCISQKGTKNRWTCIGDLNRSPHQAFRSGGFICTQNWQIYQAFQGLVLYYESCK

SEQ ID NO: 793410 - protein, 265 aa, Homo sapiens
MKQKMMARLLRTSFALLFLGLFGVLGAATISCRNEEGKAVDWFTFYKLPKRQNKESGETGLEYLYLDSTTRSWRKSEQLMNDTKSVLGRTLQQLYEAYASKSNNTAYLIYNDGVPKPVNYSRKYGHTKGLLLWNRVQGFWLIHSIPQFPPIPEEGYDYPPTGRRNGQSGICITFKYNQYEAIDSQLLVCNPNVYSCSIPATFHQELIHMPQLCTRASSSEIPGRLLTTLQSAQGQKFLHFAKSDSFLDGMKDHHQTTCCIILLLN

SEQ ID NO: 793411 - protein, 155 aa, Homo sapiens
SRAVQRIRGKKPCVHAHPKGSVLLFYIGTKSIFATSGWKCVLTYLSLLRGWNISLASHRAVVDLSRGRRRRKRAEPLSGILRSLFSCRFEDILQGLAQGEPHRVQVHTAEQDLNATSCLPWVWDPRVNGTQRGACHLSLESLLIFFNKVHTNRNS

SEQ ID NO: 793412 - protein, 102 aa, Homo sapiens
MYSIVFSNFCVDLKINTLPIVTQQKKKKTFGGLSILFGVRKTRRYSDKRGTRAQKQRDPWATAFLCPNGGRLCRDPHIREPAYFRKPRVTAILTQERESRHA

SEQ ID NO: 793413 - protein, 137 aa, Homo sapiens
ECTSERVARNECAGQEASPISGSRASDRRPAPSQAHMPRGQLDVAWGPCSLEHVAHQACLRPQSSVPALFSRTGGCPSPRPCPTRTPASRCGLVHPHGLTPGTVRGRGPALPPEAWTQGNGSQRLQSRRLCLGLAGS

SEQ ID NO: 793414 - protein, 49 aa, Homo sapiens
MIVYFDSKNKKNRIDIFSSKLLFICRYETPTLKQKQRTKQFLKTTQNKQ

SEQ ID NO: 793415 - protein, 109 aa, Homo sapiens
GSLALDVLCCDHVGSSGRGACFGFLLTCPRQLRGERLSCTSCRACSHPDLVFGLSEPAVPQAPGAGSCHAASPLQEGGHPRIPLCREDIFGTSICGRRVLGRLRSYSGE

SEQ ID NO: 793416 - protein, 168 aa, Homo sapiens
MKGKTSLAHQFVEGEFSEGYDPTVENTYSKIVTLGKDEFHLHLVDTAGQDEYSILPYSFIIGVHGYVLVYSVTSLHSFQVIESLYQKLHEGHGKTRVPVVLVGNKADLSPEREVQAVEGKKLAESWGATFMESSARENQLTQGIFTKVIQEIARVENSYGQERRCHLM

SEQ ID NO: 793417 - protein, 183 aa, Homo sapiens
MPLVRYRKVVILGYRCVGKTSLAHQFVEGEFSEGYDPTVENTYSKIVTLGKDEFHLHLVDTAGQDEYSILPYSFIIGVHGYVLVYSVTSLHSFQVIESLYQKLHEGHGKTRVPVVLVGNKADLSPEREVQAVEGKKLAESWGATFMESSARENQLTQGIFTKVIQEIARVENSYGQERRCHLM

SEQ ID NO: 793418 - protein, 564 aa, Homo sapiens
IFTVSESESTKGSADCLPKLSYQNSSSIVRLTGTSNNSAGKISGESMESTPELLLISSLEDTNETRNIQSRCFRKRHKSDNETNLQQQVVWGNRNRNLSGGVLMGFMLNRINQEATPGDIVEKLGADAKILSNVISKSTRPNTLDIGKPPLRSKRDSLEKESSDDDTPFDGSNYLADKVDSPVIFDLEDLDSETDVSKAGCVATQNPKRIQRMNSSFSVKPFEKTDVATGFDPLSLLVAETEQQQKEEEEEDEDDSKSISTPSARRDLAEEIVMYMNNMSSPLTSRTPSIDLQRACDDKLNKKSPPLVKACRRSSLPPNSPKPVRLTKSKSYTKSEEKPRDRLWSSPAFSPTCPFREESQDTLTHSSPSFNLDTLLVPKLDVLRNSMFTAGKGVAEKASKWYSRFTMYTTSSKDQSSDRTSLSSVGAQDSESTSLTDEDVCHELEGPISSQETSATSGTKRIDLSRISLESSASLEGISRSLPNWEIRKRHPTTTRSNTQLSPDNYAQGGPQHQEATGRTVMYGPDYDNPMETRAIPTTKMHTETKETHRTDTTNTVQNNTTRE

SEQ ID NO: 793419 - protein, 125 aa, Homo sapiens
LSPDADLSVTEASSSDSRGERAELYAQVEEGLLGGEASYLGPPLTPEKDDALHQATAVANLRAALMSKNSLLSLKADVLGDDGSLLFEYLPRGAHSLSRKCRPWGPLGFGVVLKAEGCRSRAKMR

SEQ ID NO: 793420 - protein, 102 aa, Homo sapiens
LSPDADLSVTEASSSDSRGERAELYAQVEEGLLGGEASYLGPPLTPEKDDALHQATAVANLRAALMSKNSLLSLKADVLGDDGSLLFEYLPRGAHSLSRVIG

SEQ ID NO: 793421 - protein, 168 aa, Homo sapiens
MILWPAYAHELPKYGVKVGLTNYAAAYCTGLLLARRLLNMFGMDKIYEGQVEVTGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNSVTPDMMEEMY

SEQ ID NO: 793422 - protein, 125 aa, Homo sapiens
PFSPSHLTSYFSFPRIAMETYIRQRQLIMSPLITSHVIGENEPLTSVLNKVIAAKEVNHKGQGLWVSLKLLPGDLTQVQKNFSHLVDRSTAIARKYVVTEVCESRKYVVRKYVVRKYVVRKYVVT

SEQ ID NO: 793423 - protein, 213 aa, Homo sapiens
PFSPSHLTSYFSFPRIAMETYIRQRQLIMSPLITSHVIGENEPLTSVLNKVIAAKEVNHKGQGLWVSLKLLPGDLTQVQKNFSHLVDRSTAIARKMGFPEIILPGDVRNDIYVTLIHGEFDKGKKKTPKNVEVTMSVHDEEGKLLEKAIHPGAGYEGISEYKSVVYYQVKQPCWYETVKVSIAIEEVTRCHIRFTFRHRSSQETRDKSERAFG

SEQ ID NO: 793424 - protein, 180 aa, Homo sapiens
PFSPSHLTSYFSFPRIAMETYIRQRQLIMSPLITSHVIGENEPLTSVLNKVIAAKEVNHKGQGLWVSLKLLPGDLTQVQKNFSHLVDRSTAIARKMGFPEIILPGDVRNDIYVTLIHGEFDKGKKKTPKNVEVTMSVHDEEGKLLEVRGMAQKSCYHRIRLYNHDRILAVFQFFFASGWV

SEQ ID NO: 793425 - protein, 392 aa, Homo sapiens
MGSLSTANVEFCLDVFKELNSNNIGDNIFFSSLSLLYALSMVLLGARGETAEQLEKVLHFSHTVDSLKPGFKDSPKCSQAGRIHSEFGVEFSQINQPDSNCTLSIANRLYGTKTMAFHQQYLSCSEKWYQARLQTVDFEQSTEETRKMINAWVENKTNGKVANLFGKSTIDPSSVMVLVNTIYFKGQRQNKFQVRETVKSPFQLSEGKNVTVEMMYQIGTFKLAFVKEPQMQVLELPYVNNKLSMIILLPVGIANLKQIEKQLNSGTFHEWTSSSNMMEREVEVHLPRFKLEIKYELNSLLKPLGVTDLFNQVKADLSGMSPTKGLYLSKAIHKSYLDVSEEGTEAAAATGDSIAVKSLPMRAQFKANHPFLFFIRHTHTNTILFCGKLASP

SEQ ID NO: 793426 - protein, 392 aa, Homo sapiens; identical to SEQ ID NO: 793425

SEQ ID NO: 793427 - protein, 290 aa, Homo sapiens
MDCSLVRTLVHRYCAGEENWVDSRTIYVGHREPPPGAEAYIPQRYPDNRIVSSKYTFWNFIPKNLFEQFRRVANFYFLIIFLVQLIIDTPTSPVTSGLPLFFVITVTAIKQGYEDWLRHKADNAMNQCPVHFIQHGKLVRKQSRKLRVGDIVMVKEDETFPCDLIFLSSNRGDGTCHVTTASLDGESSHKTHYAVQDTKGFHTEEDIGGLHATIECEQPQPDLYKFVGRINVYSDLNDPVVRPLGSENLLLRGATLKNTEKIFGVAIYTGMETKMALNYQSKSQKRSAVE

SEQ ID NO: 793428 - protein, 42 aa, Homo sapiens
MTFSKLVIPALWEAQAGGSRGQEIETILANTVKPRLYQKIQK

SEQ ID NO: 793429 - protein, 148 aa, Homo sapiens
VQNLSRPGVTRGMKTISGPRGPGPGPGRGRPGHPGTASRAAPARAGRTGGLGPGGDTKNPERQTPPAGARSNPRSAPPADKFTAPSAHPALPTRAKFPVARLGPRHRVGSRLPPPPPPAQRPFPLSPPPLPLPPTLSGAHRGAGAPRP

SEQ ID NO: 793430 - protein, 117 aa, Homo sapiens
MRTPDTSSAQDCWVPPRPLKAHHVAARPALVRRRCPGGACALPSRGAGVPRKSVWRGRGGCLGWDAVGGVGSLCKSQRSAHGPEAGLAMQRQVRLANSEGAGRNPLPLSASADVADV

SEQ ID NO: 793431 - protein, 371 aa, Homo sapiens
MELELDAGDQDLLAFLLEESGDLGTAPDEAVRAPLDWALPLSEVPSDWEVDDLLCSLLSPPASLNILSSSNPCLVHHDHTYSLPRETVSMDLESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 793432 - protein, 211 aa, Homo sapiens
MSGTPGVWDIVDQAVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 793433 - protein, 278 aa, Homo sapiens
MELELDAGDQDLLAFLLEESGDLGTAPDEAVRAPLDWALPLSEVPSDWEVDDLLCSLLSPPASLNILSSSNPCLVHHDHTYSLPRETVSMDLESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYPHLCPNKKRWARAGRSSCALSGRLRAQTHHT

SEQ ID NO: 793434 - protein, 438 aa, Homo sapiens
EKLNGTDPEDVIQQLTFACFDEEAQVYIHVGSSRPGAAHSPLGDRFHTMRNVERRCTEECTHGVTKGNFNYVEVHPILKHGAKDKDDQCHRTAPDEAVRAPLDWALPLSEVPSDWEVDDLLCSLLSPPASLNILSSSNPCLVHHDHTYSLPRETVSMDLESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 793435 - protein, 182 aa, Homo sapiens
MELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 793436 - protein, 182 aa, Homo sapiens; identical to SEQ ID NO: 793435

SEQ ID NO: 793437 - protein, 160 aa, Homo sapiens
MELELDAGDQDLLAFLLEESGDLGTAPDEAVRAPLDWALPLSEVPSDWEVDDLLCSLLSPPASLNILSSSNPCLVHHDHTYSLPRETVSMDLESESCRKEGTQMTPQHMEELAEQWPFPDLFSEPLCRGPILPLQANLTRKGGWLPTGSPSVILQDRYSG

SEQ ID NO: 793438 - protein, 156 aa, Homo sapiens
MVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 793439 - protein, 394 aa, Homo sapiens
MELELDAGDQDLLAFLLEESGDLGTAPDEAVRAPLDWALPLSEVPSDWEVDDLLCSLLSPPASLNILSSSNPCLVHHDHTYSLPRETVSMDLGVEISLTGRTGFMGLAIHTFPFAESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 793440 - protein, 344 aa, Homo sapiens
MELELDAGDQDLLAFLLEESGDLGTAPDEAVRAPLDWALPLSEVPSDWEVDDLLCSLLSPPASLNILSSSNPCLVHHDHTYSLPRETVSMDLESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHHAEPPLEWPFPDLFSEPLCRGPILPLQANLTRKGGWLPTGSPSVILQDRYSG

SEQ ID NO: 793441 - protein, 234 aa, Homo sapiens
MELELDAGDQDLLAFLLEESGDLGTAPDEAVRAPLDWALPLSEVPSDWEVDDLLCSLLSPPASLNILSSSNPCLVHHDHTYSLPRETVSMDLESESCRKEGTQMTPQHMEELAEQEIARLVLTDEEKSLLEKEGLILPETLPLTKTEEQILKRVRRKIRNKRSAQESRRKKKVYVGGLESRYERERDSVVSIRFLKGGYRPYPRIFVISPRVLKYTAQNMELQNKVQLLEEQNL

SEQ ID NO: 793442 - protein, 293 aa, Homo sapiens
RYPVRRRLSLSMDLESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 793443 - protein, 182 aa, Homo sapiens; identical to SEQ ID NO: 793435

SEQ ID NO: 793444 - protein, 85 aa, Homo sapiens
GVGEAGLGARGRCSRAGIWGFSGTAAAAVGGPWRGDERPVSGVSEPVSPAGEEGERGQRLVSLRRAPRRQGRPRRGRHLLGALES

SEQ ID NO: 793445 - protein, 245 aa, Homo sapiens
MGSFPLGMLLFLCGANVKLLTPRHSHTQPGLPPLQAPAPPSLLVTQPYPLLGTLPLVQLGRLLVLVEPQLGRLEGLQALPHGPVEDFPVLFLVLRGRELVSAVQMLVLRDQARRSQLCPAPDILALLPQELSTDPPWSQEGTRKPPHGVPAGSSSPQPAVPTSCRGLYRPGATTALSVTLSSRGWALPQGSCMTMATYRRKETEASTVDDRGVKSTLTTLSVLGERMKARDPRRSPCGQEAARRP

SEQ ID NO: 793446 - protein, 187 aa, Homo sapiens
IGLMSRTESARSHHSPVCDSQLPRLGSSPGKLHDHGHIQEVGDRGLHGGRSWREVHVDHVVGAGGADEGQGPAALLPVVRKQPGDPKTPLASCPELNQPVPEPAAAPTRQSKRLCYLSHVADGILQVQLVEDIQDPVSRLLGRPSHEDPAEELPVEVGPPVGTDLGCEPQVTGALEPAGRVARPLLS

SEQ ID NO: 793447 - protein, 279 aa, Homo sapiens
MPPQVWGPPLLSGREEPTGSPHAAEPRVVVVGRGSRMVAGVVGGEAQGPPANLVTYVGVRGARQRPEPPLSLPTLQPGSRPPRARVSELSLACRACGLGVCVEPGPGALLPDLHWLALLTAPGPRALCQEVPCHLAWPSHGWHIWGECTSVEAESFCLNEWSFQAPTGPLCEGLQGLAGQVFLSGESTHPDRLLDEGTKARWEGSVLREELRNPCSCAPRPCLAHFLQPGRPWGGQGRPGRLRPTCHSGQVREPGRQWPRGWVGRLASGLWSSQGLCRR

SEQ ID NO: 793448 - protein, 134 aa, Homo sapiens [sequence omitted]

SEQ ID NO: 793449 - protein, 161 aa, Homo sapiens
MLPMAGLKLLGSSDPLASASQSAEITGAHHHAQLAFFFNELLLCVLWPFFHSEIIPIFLIDIYITALYTHTRTYIYIKVINLLLYKLSAFLLFLTFTYYGIVIIFFYTAVWFPHQFISFRSLYTLNNVEVLISPIDSHSLALPMSLAPFGWLLSISSPTRG

SEQ ID NO: 793450 - protein, 38 aa, Homo sapiens
MNSPNGSRLPSVSPPFVNPEPLFLSKETEFYIDGSVAP

SEQ ID NO: 793451 - protein, 124 aa, Homo sapiens
LRSMWTEAHSHIFIQVRADLDVVLKTTQQKQANSPELNNSLHPTPHTKGPTLPTGLELVNRPPSSTELGRPNPLALEAGKLPCEDPELDDDFDAHKALEDDEELAHLGLGVDVAKGDDELGTLE

SEQ ID NO: 793452 - protein, 348 aa, Homo sapiens
HSASDYEELLIRQQIQRNTLRQEKETAAAAAGAVGPPGSWGAEPSSPAFEQLSRGQTPFAGTQDKSSLVGLPPSKLSGPILGPGSFPSDDRLSRPPPPATPSSMDVNSRQLVGGSQAFYQRAPYPGSLPLQQQQQQLWQQQQATAATSMRFAMSARFPSTPGPELGRQALGSPLAGISTRLPGPGEPVPGPAGPAQFIELRHNVQKGLGPGGTPFPGQGPPQRPRFYPVSEDPHRLAPEGLRGLAVSGLPPQKPSAPPAPELNNSLHPTPHTKGPTLPTGLELVNRPPSSTELGRPNPLALEAGKLPCEDPELDDDFDAHKALEDDEELAHLGLGVDVAKGDDELGTL

SEQ ID NO: 793453 - protein, 69 aa, Homo sapiens
VIQTPILLHLSGLSLISSCQETDDGGREAFWLSQASGSPKGFERPPDKQTQALSPGHSLFKKHQVYEFP

SEQ ID NO: 793454 - protein, 112 aa, Homo sapiens
CIGGRRESVWHSHLGPRVSQEAALNPATSQLPKNSKGSTSLSGGSRISTLGLQSGRRLCVQGKEWYLKAVFAQHIALDLKNVHHPFQTVGALLIKIIKAFRTHPPHKLPPAP

SEQ ID NO: 793455 - protein, 143 aa, Homo sapiens
PDAHSSLACGQRPTESQAVGHASDPVGRASGASAGTCLLHQHNGVHRLALVGLGRAGTQSPSAPPPARGPRSLGRGRGCGRCGPDPCGEGSSLQQPGRSGGPGDPRAGAPAGGGVGAGEGEWRRLGQRRGRAGGDARCGAPRF

SEQ ID NO: 793456 - protein, 30 aa, Homo sapiens
NVNDRVPVSLVSCSYLWVKLSFPDCYQNSP

SEQ ID NO: 793457 - protein, 76 aa, Homo sapiens
CFRLAVSPVSVAAPLMSCTHHPRRSPQNLADCLQSNRGSLLHLHCCLCAFIISQPSFHMSMVVQACNLSSSGGRIT

SEQ ID NO: 793458 - protein, 112 aa, Homo sapiens
QVYTASFLNFYSVEMKSPYVAQAGLELLSLNNPPTHTSQSAGITGVSHCAPPQIHFTTISSIQRMRDSDAINMKTLSFSIQFQRAQTNYSDQKWVTNSSNSIFTSSYKIRNC

SEQ ID NO: 793459 - protein, 101 aa, Homo sapiens
MSCTTCRDSESRQVVHLINYQDDAELATRALPELTKLLNDEDPVVVTKAAMMVNQLSKKEASRRALMGSPQLVAAVVRTMQNTRDLDTARCTTSILHNGYR

SEQ ID NO: 793460 - protein, 298 aa, Homo sapiens
GTRHQMADDAGAAGGPGGPGGPGMGNRGGFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 793461 - protein, 298 aa, Homo sapiens; identical to SEQ ID NO: 793460

SEQ ID NO: 793462 - protein, 205 aa, Homo sapiens
MSVDPMTYEAQFFGFTPQTCMLRIYIAFQDYLFEVMQAVEQVILKKLDGIPDCDISPVQIRKCTEKFLCFMKGHFDNLFSKMEQLFLQLILRIPSNILLPEDKCKETPYSEEDFQHLQKEIEQLQEKYKTELCTKQALLAELEEQKIVQAKLKQTLTFFDELHNVGRDHGTSDFRESLVSLVQNSRKLQNIRDNVEKESKRLKIS

SEQ ID NO: 793463 - protein, 205 aa, Homo sapiens; identical to SEQ ID NO: 793462

SEQ ID NO: 793464 - protein, 205 aa, Homo sapiens; identical to SEQ ID NO: 793462

SEQ ID NO: 793465 - protein, 205 aa, Homo sapiens; identical to SEQ ID NO: 793462

SEQ ID NO: 793466 - protein, 148 aa, Homo sapiens [sequence omitted]

SEQ ID NO: 793467 - protein, 53 aa, Homo sapiens
MLEADSCHRLRPTEERRGKGVEGHTGRRSRVTRDHHRPQPRPLHCGGAGAPRT

SEQ ID NO: 793468 - protein, 136 aa, Homo sapiens
MSQEGRLCLQSQLGSPNIRDPEGSGSDQRHLKGPCGILAIHPLPCTSFFPELQGYTSGRLPRPNSTSVPILDPLTHKTRSEAVMQPLGTNRQSPGLLTPGNKACSFALLHFKVQAAFKLTRQSFVFSSKAESTVLC

SEQ ID NO: 793469 - protein, 470 aa, Homo sapiens
MGKPWLRALQLLLLLGASWARAGAPRCTYTFVLPPQKFTGAVCWSGPASTRATPEAANASELAALRMRVGRHEELLRELQRLAAADGAVAGEVRALRKESRGLSARLGQLRAQLQHEAGPGAGPGADLGAEPAAALALLGERVLNASAEAQRAAARFHQLDVKFRELAQLVTQQSSLIARLERLCPGGAGGQQQVLPPPPLVPVVPVRLVGSTSDTSRMLDPAPEPQRDQTQRQQEPMASPMPAGHPAVPTKPVGPWQDCAEARQAGHEQSGVYELRVGRHVVSVWCEQQLEGGGWTVIQRRQDGSVNFFTTWQHYKAGFGRPDGEYWLGLEPVYQLTSRGDHELLVLLEDWGGRGARAHYDGFSLEPESDHYRLRLGQYHGDAGDSLSWHNDKPFSTVDRDRDSYSGNCALYQRGGWWYHACAHSNLNGVWHHGGHYRSRYQDGVYWAEFRGGAYSLRKAAMLIRPLKL

SEQ ID NO: 793470 - protein, 101 aa, Homo sapiens
MVTLKPRLHHSAIYSCNKTALVPLNIYFKKVSQRMFSFTRHFVFISFLFFFFFEMDSCSVAQDECSGVILAHCNLCLPGSSDSPASASRVAEITGTRHHIR

SEQ ID NO: 793471 - protein, 108 aa, Homo sapiens [sequence omitted]

SEQ ID NO: 793472 - protein, 85 aa, Homo sapiens
MRGLGAPTADSNSAGQKRNAHAGALVEVEGREVRRGAAPTAEQTWVPDQADPGPPSLPQPPAPLAHPVVLAPFWMAACLTDWSPP

SEQ ID NO: 793473 - protein, 94 aa, Homo sapiens
LPAVILPMAVDGPDGAWSPQNVQKLDKGGLQMQWLSYHRKPTASRGGPLLRSLQRAQVSVRPKFPLLPNAGEERILEAHPVPWLPWHMEPLNVL

SEQ ID NO: 793474 - protein, 281 aa, Homo sapiens
VFSIWGRSQLSAHGPASFKMSTVHEILCKLSLEGDHSTPPSAYGSVKAYTNFDAERDALNIETAIKTKGVDEVTIVNILTNRSNAQRQDMAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIFQVSFNLFRDAFQHVYKG

SEQ ID NO: 793475 - protein, 289 aa, Homo sapiens
MVKGVDEATIIDLLTKRNHAQRQQIQAAYLQETGKPLDETLKKALTGHLEEVVLALLKTPAPFDADELRASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADQLYDSMKGKGTRDKVLIRIMVSRSEVDMLKIRSEFKRKYGKSLYYYIQQDTKGDYQQSPWPSL

SEQ ID NO: 793476 - protein, 354 aa, Homo sapiens
VFSIWGRSQLSAHGPASFKMSTVHEILCKLSLEGDHSTPPSAYGSVKAYTNFDAERDALNIETAIKTKGVDEVTIVNILTNRSNAQRQDMAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVPHLQKVFDRYKSYSPYDMLESIRKEVKGDLENAFLNLVQCIQNKPLYFADQLYDSMKGKGTRDKVLIRIMVSRSEVDMLKIRSEFKRKYGKSLYYYIQQDTKGDYQQSPWPSL

SEQ ID NO: 793477 - protein, 102 aa, Homo sapiens
GLPTLPLEWKHYHFFPPPAEKVMSLGRNWHRPCLRCQRCHKTLTAGSHAEHDGVPYCHVPCYGYLFGPKGGQPHPRHWDGMYMPEVWHVHGLWVCVDNFPCG

SEQ ID NO: 793478 - protein, 140 aa, Homo sapiens
HKPCYGALFGPRGVNIGGVGSYLYNPPTPSPGCTTPLSPSSFSPPRPRTGLPQGKKTEKVMSLGRNWHRPCLRCQRCHKTLTAGSHAEHDGVPYCHVPCYGYLFGPKGGQPHPRHWDGMYMPEVWHVHGLWVCVDNFPCG

SEQ ID NO: 793479 - protein, 127 aa, Homo sapiens
HKPCYGALFGPRGVNIGGVGSYLYNPPTPSPGCTTPLSPSSFSPPRPRTGLPQGKKTEKVMSLGRNWHRPCLRCQRCHKTLTAGSHAEHDGVPYCHVPCYGYLFGPKGVNIGDVGCYIYDPVKIKFK

SEQ ID NO: 793480 - protein, 140 aa, Homo sapiens; identical to SEQ ID NO: 793478

SEQ ID NO: 793481 - protein, 140 aa, Homo sapiens; identical to SEQ ID NO: 793478

SEQ ID NO: 793482 - protein, 109 aa, Homo sapiens
HKPCYGALFGPRGVNIGGVGSYLYNPPTPSPGCTTPLSPSSFSPPRPRTGLPQGKKTEKVMSLGRNWHRPCLRCQRCHKTLTAGSHAEHDGVPYCHVPCYGYLFGPKAL

SEQ ID NO: 793483 - protein, 89 aa, Homo sapiens
HKPCYGALFGPRGVNIGGVGSYLYNPPTPSPGCTTPLSPSSFSPPRPRTGLPQGKKTEKVMSLGRNWHRPCLRCQRCHKTLTAGSHAEV

SEQ ID NO: 793484 - protein, 71 aa, Homo sapiens
GWRWEENQAETALFLSVSQHDGVPYCHVPCYGYLFGPKGGQPHPRHWDGMYMPEVWHVHGLWVCVDNFPCG

SEQ ID NO: 793485 - protein, 59 aa, Homo sapiens
MAPPGPANYSCSPTQKRFSTRGGSCLTPYGLGPPPPKTIKRKAPMPSTPPSPKYFGNLF

SEQ ID NO: 793486 - protein, 75 aa, Homo sapiens
SPEGPRLDGTVHLHHHHQPGFVGERIFCHLFLDAHKSSAPGRQHTTPARWNLTLLPRLECSECNGSLQSLPPRFK

SEQ ID NO: 793487 - protein, 130 aa, Homo sapiens
MVVVVMVVVLIRVALVVLWVGAPWLRGAPQLPLTQVHEEQVIELGGGGGEVDLVGKDAHPLLQHQDDVRAERVLQEVGGALLAAGGRVGHHDDRGRWLGGEEGCLQQRPLHIAEVGLPELQVAAGDECSS

SEQ ID NO: 793488 - protein, 129 aa, Homo sapiens
PGYQTELVIQLVWVGGEPPQQITSLAVNSSYGLVVFGNCNGIAMVDYLQKAVLLNLGTIELYGSNDPYRREPRSPRKSRQPSGAGLCDISEGTVVPEDRCKSPTSGSSSPHNSDDEQKMNNFIEKGIVS

SEQ ID NO: 793489 - protein, 185 aa, Homo sapiens
PGYQTELVIQLVWVGGEPPQQITSLAVNSSYGLVVFGNCNGIAMVDYLQKAVLLNLGTIELYGSNDPYRREPRSPRKSRQPSGAGLCDISEGTVVPEDRCKSPTSDCSHGFPYQPSALAFDPVQKILAVGTQTGALRLFGRPGVECYCQHDSGAAVIQLQFLINEGALVSALADDTLHLWNSSEV

SEQ ID NO: 793490 - protein, 104 aa, Homo sapiens
TPGAGICPQAWVTRHSRRKGLIRPSAEFTPSALQPQMPLNRAKAGPSSAIDAQDAEWGCGLRQGYQLCGLRKSTDLSEFQFPERQSVGNSTQGLNEIVHVQHLA

SEQ ID NO: 793491 - protein, 112 aa, Homo sapiens
SESRAARATSCAGRKVGATSRSGGGCGREGPFPSRCPAREARPGPGPPPPLCRTLSHFLLVAYASPAALAGEACPRPGAGSYGGGGRGSTPEPPQTPSSLQWKRVLLSFRAL

SEQ ID NO: 793492 - protein, 74 aa, Homo sapiens
NDGPQLNDGPQLNDGPQLNDGPQLNDGPQLNDWCLSLQKCWDYRREPPCLAKGYGFYFVLSAHLQDPSELRTIV

SEQ ID NO: 793493 - protein, 98 aa, Homo sapiens
KEWFLEIEFTPGEDAANIVDMITKDLESYINMIEKAVAGLERIDFNFERSSTVNKMLSNSITYYRKIFHEKESIDSSFIVAFILRNYHNHPNLQQPPS

SEQ ID NO: 793494 - protein, 902 aa, Homo sapiens
TVSLCQTRLKKEHYFILIKQVYAATRTMESTLTLATEQPVKKNTLKKYKIACIVLLALLVIMSLGLGLGLGLRKLEKQGSCRKKCFDASFRGLENCRCDVACKDRGDCCWDFEDTCVESTRIWMCNKFRCGETRLEASLCSCSDDCLQRKDCCADYKSVCQGETSWLEENCDTAQQSQCPEGFDLPPVILFSMDGFRAEYLYTWDTLMPNINKLKTCGIHSKYMRAMYPTKTFPNHYTIVTGLYPESHGIIDNNMYDVNLNKNFSLSSKEQNNPAWWHGQPMWLTAMYQGLKAATYFWPGSEVAINGSFPSIYMPYNGSVPFEERISTLLKWLDLPKAERPRFYTMYFEEPDSSGHAGGPVSARVIKALQVVDHAFGMLMEGLKQRNLHNCVNIILLADHGMDQTYCNKMEYMTDYFPRINFFYMYEGPAPRIRAHNIPHDFFSFNSEEIVRNLSCRKPDQHFKPYLTPDLPKRLHYAKNVRIDKVHLFVDQQWLAVRSKSNTNCGGGNHGYNNEFRSMEAIFLAHGPSFKEKTEVEPFENIEVYNLMCDLLRIQPAPNNGTHGSLNHLLKVPFYEPSHAEEVSKFSVCGFANPLPTESLDCFCPHLQNSTQLEQVNQMLNLTQEEITATVKVNLPFGRPRVLQKNVDHCLLYHREYVSGFGKAMRMPMWSSYTVPQLGDTSPLPPTVPDCLRADVRVPPSESQKCSFYLADKNITHGFLYPPASNRTSDSQYDALITSNLVPMYEEFRKMWDYFHSVLLIKHATERNGVNVVSGPIFDYNYDGHFDAPDEITKHLANTDVPIPTHYFVVLTSCKNKSHTPENCPGWLDVLPFIIPHRPTNVESCPEGKPEALWVEERFTAHIARVRDVELLTGLDFYQDKVQPVSEILQLKTYLPTFETTI

SEQ ID NO: 793495 - protein, 318 aa, Homo sapiens
TVSLCQTRLKKEHYFILIKQVYAATRTMESTLTLATEQPVKKNTLKKYKIACIVLLALLVIMSLGLGLGLGLRKLEKQGSCRKKCFDASFRGLENCRCDVACKDRGDCCWDFEDTCVESTRIWMCNKFRCGETRLEASLCSCSDDCLQRKDCCADYKSVCQGETSWLEENCDTAQQSQCPEGFDLPPVILFSMDGFRAEYLYTWDTLMPNINKLKTCGIHSKYMRAMYPTKTFPNHYTIVTGLYPESHGIIDNNMYDVNLNKNFSLSSKEQNNPAWWHGQPMWLTAMYQGLKAATYFWPGSEVAINGSFPSIYMPYNG

SEQ ID NO: 793496 - protein, 78 aa, Homo sapiens
DDTVDAELFYRSRAHMTVQKVMARSRRSARDTRSSARLSQSSQDSSPVRNLQSFGTEEPAYSTRRVTRSQQQPTPVTP

SEQ ID NO: 793497 - protein, 106 aa, Homo sapiens
SNCQAVAVELLLTLQLVLCVFASTDSRQTSGSPATMIGISVALGRLIGLSLQEDTKKRSRQHVANVARRHPIICNPRGKPSPHTNPAGSLLLDFQFQNYEKIHFCV

SEQ ID NO: 793498 - protein, 86 aa, Homo sapiens
SPSTHVPLTEDGSFSIADGHPLLPSTQLWKERIWSAVSPGGHKEKIKTACSKCSKEASNHLQPKGQTLATHQPCWLLAFGLPVSEL

SEQ ID NO: 793499 - protein, 134 aa, Homo sapiens
LKPEPVALCYSFPGKHAAPTAGALSWQHSICHGPPGDALAAPASAHVQGNPVGAQIQPQDTGPAEAANPPVPPVTLSGGPAHSMGVMWWSPCREGTWSQDREGPCLIQWARVRVLGPPTACVGGSREVGGSRPA

SEQ ID NO: 793500 - protein, 146 aa, Homo sapiens
TASQGRRIFLSTEQNGVSYVYFFLHRHSNNLISLSFPHISPFSIRQNRHRHHGPFSMSCWVHLPDGVAAGQRGSSLPRRGGWAEAPPTSRKGQWPGGGCPPPPSRMGRMSFFSYVCWSHKCKLGKFTHIFGLLKAELFYFRKCISK

SEQ ID NO: 793501 - protein, 62 aa, Homo sapiens
MHRWTRERPARGGGEGRVRPGDPSDHLHVELARASLARRGGRPIHLAEGVLHREVVFVLPAA

SEQ ID NO: 793502 - protein, 157 aa, Homo sapiens
RPPSSPRPAQPLRRSRGAAPSHGPGWRAGCGQDPGARALARGKDRNGASGGTLPHRLYMAKFLAELLGCTLPSKGASPMFESKSHSRVGLKSSTKQKTTIFSTLASEKSLSDCKKEQQWKPSMYSSITPVCFPSPLIEKPIGKVRMNLLLSDTMIRA

SEQ ID NO: 793503 - protein, 80 aa, Homo sapiens
AAAELSPPGPAPPPQPRGSPEPRPRLAGGLRAGSWRSGSGKGKGQKRRIGRDPASPLVYGKVSRRAPGLHVAEQGRLSHV

SEQ ID NO: 793504 - protein, 117 aa, Homo sapiens
RPPSSPRPAQPLRRSRGAAPSHGPGWRAGCGQDPGARALARGKDRNGASGGTLPHRLYMAKFLAELLGCTLPSKGASPMFESKSHSRVGLKSSTKQKTTIFSTLASEKSLSDCKKDN

SEQ ID NO: 793505 - protein, 80 aa, Homo sapiens; identical to SEQ ID NO: 793503

SEQ ID NO: 793506 - protein, 132 aa, Homo sapiens
RPPSSPRPAQPLRRSRGAAPSHGPGWRAGCGQDPGARALARGKDRNGASGGTLPHRLYMAKFLAELLGCTLPSKGASPMFESKSHSRVGLKSSTKQKTTIFSTLASEKSLSDCKKAYSDQTLERSRFLMNAC

SEQ ID NO: 793507 - protein, 157 aa, Homo sapiens
QRLTDILKPEPWQYYFKPMMKEFGRESYYGSSLDGPDMRSSGLEILRDNGRWQGKERTYARDTLREWTVFGTSVCGEERGRKERRKGLKRPLQGPSNCRYSAPQSRISFLLPPPSRTPFPGSPLHLESLYLPSYPLISHPLTPALSLSISFFLSCYK

SEQ ID NO: 793508 - protein, 38 aa, Homo sapiens
MQGTMSNHPLKGTASNYPQLINFPPMKMTVLAQQTPVL

SEQ ID NO: 793509 - protein, 121 aa, Homo sapiens
MIPILQGHLFCGHRGHLGSRSGLSSPAWGTVCSVSRLWNKEDSCFSEEPHLLRGKILCLSESFTFCEPAPWPDRVTGPRSGQGSFCECIERQECPGGCVVFGPIPVIASGNAISGVCPRCL

SEQ ID NO: 793510 - protein, 121 aa, Homo sapiens; identical to SEQ ID NO: 793509

SEQ ID NO: 793511 - protein, 78 aa, Homo sapiens
QRRISCQGLAIKFFKRLKEQKGGRSGSQTKGKKGFAATDQELLRPLAWSPEPTFATELSELLWPLQCSEAQESLCQCC

SEQ ID NO: 793512 - protein, 70 aa, Homo sapiens
TLAQLTCNSYQPQEQIAKMVTIHLLPALQCDFAAPSFKRSGLFLYPLNLGSSCDFGQRNAAEERMCQFQA

SEQ ID NO: 793513 - protein, 100 aa, Homo sapiens
SSKKPRRRMDRYNKICSTVVTLGVEMGLELLQALHGQLLTSHLDSGHQLLGRSCPASHDSISSGEGAPGPRDFSATMRSQTSCGGTLSSQLQSNPLQRVC

SEQ ID NO: 793514 - protein, 104 aa, Homo sapiens
PLDGGAGLPGGKSAGRGAPRIGVEGPAPQAVPRGGGSATRAAGPGRGRGGFSQLWTRARRGWGLVEPILDPAVGSLCSESGPKSGTLEGPQGNSATAESGTGSG

SEQ ID NO: 793515 - protein, 115 aa, Homo sapiens
MYLLSFCFTIEVDGTLNFWVHGNMLKTEHNPDHHSCLAVSWEAAGCHGAGTQQSPLGVAGPWRPRPPCVGSLLAARSLHKQVILFGLLGFAYDLQPNLGCRGSSAGPCSFVCWVT

SEQ ID NO: 793516 - protein, 107 aa, Homo sapiens
QHGAHVLVSLCPLDAMEKVSCSKGATQLGTFLAMEQLLQQAGSECTVDVFNVALQQSQACDLMTPTLKQYIYLYNCLNSALADGLPLSRHWSLCRRGLCPVGWGQHS

SEQ ID NO: 793517 - protein, 130 aa, Homo sapiens
QHGAHVLVSLCPLDAMEKVSCSKGATQLGTFLAMEQLLQQAGSECTVDVFNVALQQSQACDLMTPTLVRGDGAGVGAWGLSCGKGWEVRELLPRPLGSTTRVATRWRCGPLCILPDGALGVGTHKGALFC

SEQ ID NO: 793518 - protein, 73 aa, Homo sapiens
CLQALCHRQSSDLTQLLYIGWSAATSLELKEKHFVKVLEEHLRAGRGGALSRKCSHPCMFEKHAVIFILHLLS

SEQ ID NO: 793519 - protein, 106 aa, Homo sapiens
MECAPTINIKFYACCTFQKAQEDIDSRPVFSVMSPQDRRLYGQKSCIFNTENPITSFDVTEVDLPPEIRDSAPCWRCPTLPEMCRCQVDYLEKMLQEKVNPDSQAS

SEQ ID NO: 793520 - protein, 69 aa, Homo sapiens
SLNKPSDLTGPRAANDMVYKKRLIEPPYRNATLLLLILHITLGSLLSRNRNQDFCLFLHHGFFKSRILK

SEQ ID NO: 793521 - protein, 172 aa, Homo sapiens
MGGCSSLPTPGVSRACHCGPAPYALHLVSLPTDLLIPSQNILSREGRRSFKKSGGVGLDPGQGGGSDLALGPSSLLPCAKNWGRAGGGQSPLLYTQGGILTPKPRLSTPWRTPVTSLLCLWRTLGESYRRSNNRLGQVTALHQAAAHASALAPPGDSLPIPSLCRRMCVAPS

SEQ ID NO: 793522 - protein, 556 aa, Homo sapiens
MALVALVAGARLGRRLSGPGLGRGHWTAARRSRSRREAAEAEAEVPVVQYVGERAARADRVFVWGFSFSGALGVPSFVVPSSGPGPRAGARPRRRIQPVPYRLELDQKISSAACGYGFTLLSSKTADVTKVWGMGLNKDSQLGFHRSRKDKTRGYEYVLEPSPVSLPLDRPQETRVLQVSCGRAHSLVLTDREGVFSMGNNSYGQCGRKVVENEIYSESHRVHRMQDFDGQVVQVACGQDHSLFLTDKGEVYSCGWGADGQTGLGHYNITSSPTKLGGDLAGVNVIQVATYGDCCLAVSADGGLFGWGNSEYLQLASVTDSTQVNVPRCLHFSGVGKVRQAACGGTGCAVLNGEGHVFVWGYGILGKGPNLVESAVPEMIPPTLFGLTEFNPEIQVSRIRCGLSHFAALTNKGELFVWGKNIRGCLGIGRLEDQYFPWRVTMPGEPVDVACGVDHMVTLAKSFIYNLPHLLGRPRPGNHWHSLAEASAWPAPRGSWMVVAEDPACSVTLCPESLSGYLPGGSGQGPSPAAGEACGTQLGWQPLVGRCGPHVSVLSK

SEQ ID NO: 793523 - protein, 556 aa, Homo sapiens; identical to SEQ ID NO: 793522

SEQ ID NO: 793524 - protein, 634 aa, Homo sapiens
MALVALVAGARLGRRLSGPGLGRGHWTAARRSRSRREAAEAEAEVPVVQYVGERAARADRVFVWGFSFSGALGVPSFVVPSSGPGPRAGARPRRRIQPVPYRLELDQKVQAAASSLSPSLSSALPASLDLFGSLQEVGSSGWTDFRQDDPQSWLQAQEGKALGVAINIYWVAVPDVVPGRVIRLAPISSAACGYGFTLLSSKTADVTKVWGMGLNKDSQLGFHRSRKDKTRGYEYVLEPSPVSLPLDRPQETRVLQVSCGRAHSLVLTDREGVFSMGNNSYGQCGRKVVENEIYSESHRVHRMQDFDGQVVQVACGQDHSLFLTDKGEVYSCGWGADGQTGLGHYNITSSPTKLGGDLAGVNVIQVATYGDCCLAVSADGGLFGWGNSEYLQLASVTDSTQVNVPRCLHFSGVGKVRQAACGGTGCAVLNGEGHVFVWGYGILGKGPNLVESAVPEMIPPTLFGLTEFNPEIQVSRIRCGLSHFAALTNKGELFVWGKNIRGCLGIGRLEDQYFPWRVTMPGEPVDVACGVDHMVTLAKSFIYNLPHLLGRPRPGNHWHSLAEASAWPAPRGSWMVVAEDPACSVTLCPESLSGYLPGGSGQGPSPAAGEACGTQLGWQPLVGRCGPHVSVLSK

SEQ ID NO: 793525 - protein, 202 aa, Homo sapiens
MALVALVAGARLGRRLSGPGLGRGHWTAARRSRSRREAAEAEAEVPVVQYVGERAARADRVFVWGFSFSGALGVPSFVVPSSGPGPRAGARPRRRIQPVPYRLELDQKISSAACGYGFTLLSSKTADVTKVWGMGLNKDSQLGFHRSRKDKTRGYEYVLEPSPVSLPLDRPQETRVLQVSCGRAHSLVLTDREGDPEIVNNV

SEQ ID NO: 793526 - protein, 648 aa, Homo sapiens
LSLGLPSAPLPSTRSKSGRSLFRRGLVLRVTQDGGAQRLLRRGTEDGAGGVGGWGSAGAAAERAGAGARALDGGQALPEPARSGRSRGGGARGPVRGRARCPRRSRLRVGLQLLGGAGRAFLCGAQLRARAPRRRPTAPQDPARALSPGAGPKARGYEYVLEPSPVSLPLDRPQETRVLQVSCGRAHSLVLTDREGVFSMGNNSYGQCGRKVVENEIYSESHRVHRMQDFDGQVVQVACGQDHSLFLTDKGEVYSCGWGADGQTGLGHYNITSSPTKLGGDLAGVNVIQVATYGDCCLAVSADGGLFGWGNSEYLQLASVTDSTQVNVPRCLHFSGVGKVRQAACGGTGCAVLNGEGHVFVWGYGILGKGPNLVESAVPEMIPPTLFGLTEFNPEIQVSRIRCGLSHFAALTNKGELFVWGKNIRGCLGIGRLEDQYFPWRVTMPGEPVDVACGVDHMVTLAKSFIYNLPHLLGRPRPGNHWHSLAEASAWPAPRGSWMVVAEDPACSVTLCPESLSGYLPGGSGQGPSPAAGGGLRNSAWMAAFGGPLWPARLCSLQVTCDGVWCHVSPEKPVLGKLSLNTVLGRFLLCLSWQSLGLCLAKAMRVPRTEPQLRRGSQAGFGPRFSFRPPCSWPFLAACHTASSLGGH

SEQ ID NO: 793527 - protein, 212 aa, Homo sapiens
MALVALVAGARLGRRLSGPGLGRGHWTAARRSRSRREAAEAEAEVPVVQYVGERAARADRVFVWGFSFSGALGVPSFVVPSSGPGPRAGARPRRRIQPVPYRLELDQKISSAACGYGFTLLSSKTADVTKVWGMGLNKDSQLGGSLWWAAVARTSLFSPTTLTAWLGKVKKPLRKRIEAKFLCAEGPEHIRQGSAAVPGGGGRSRNCEQCLI

SEQ ID NO: 793528 - protein, 188 aa, Homo sapiens
MALVALVAGARLGRRLSGPGLGRGHWTAARRSRSRREAAEAEAEVPVVQYVGERAARADRVFVWGFSFSGALGVPSFVVPSSGPGPRAGARPRRRIQPVPYRLELDQKISSAACGYGFTLLSSKTADVTKVWGMGLNKDSQLGKVKKPLRKRIEAKFLCAEGPEHIRQGSAAVPGGGGRSRNCEQCLI

SEQ ID NO: 793529 - protein, 298 aa, Homo sapiens
MRSPSAAWLLGAAILLAASLSCSGTIQGTNRSSKGKKPYGIEVDGNHTQIELEEGVTVETALTLGIELFLCFCVPSWENCDHWLSPFTMVIQQMAVGGGLAKNGMALWVFLFRTKKKHPAVIYMANLALADLLSVIWFPLKMGYHIHGNNWIYGEALCNVLIGFFYGKHVLFHSLHDLAQCAEVSGHREPHGALRKKENCHWISLEIWLLILAGQQSLGCREADHLNLGRGKSRTWSCTFACKSTCGASNAFKNITHRGKGAYMVHNNPTKPANGGENTKADMCRGKTDERVGRTHDT

SEQ ID NO: 793530 - protein, 81 aa, Homo sapiens
VVQPLKHSRFGFKSKLELQKLKSEEWWTLYAIEISSCHAVSCFIKMPKWQGTDVCSQKPATQGLPKATCMNLEVDLFSIGP

SEQ ID NO: 793531 - protein, 147 aa, Homo sapiens
IHSRTRATWSQSPCSLLLLSLASEIAPYPPLPLLSCSVAQLLPFSCHLTSLDLRFSILALHENHQGVLRNADAQADRVQGRARVTGIFPTLSGDVSALWGLRSPTQGGASTLKAPASCPTQVPSSLTPPLSTTCQCDSSIWHGKQKK

SEQ ID NO: 793532 - protein, 146 aa, Homo sapiens
MFITNNSIQVSTPPPPHHVQLNHVEFEDQDDEARVQYEGFRPGMYVRVEIENVPCEFVQNFDPHYPIILGGLGNSEGNVGHVQMRLKKHRWYKKILKSQDPIIFSVGWRRFQTILLYYIEDHNGRQRLLKYTPQHIHCGAAFWGKI

SEQ ID NO: 793533 - protein, 105 aa, Homo sapiens
MFITNNSIQVSTPPPPHHVQLNHVEFEDQDDEARVQYEGFRPGMYVRVEIENVPCEFVQNFDPHYPIILGGLGNSEGNVGHVQVGPFAAYLVPEALWISPPSIIL

SEQ ID NO: 793534 - protein, 71 aa, Homo sapiens
MESSLVSLLEEIELIFGEPVIFKGRPYLDKMKSDKVEMLYWLQQQRRVRHLVSALKDPHQSTLFRSSAASL

SEQ ID NO: 793535 - protein, 83 aa, Homo sapiens
SCFNLSAMFLQGAPGFPKDMDLACKYSMKACDLGHIWACANASRMYKLGDGVDKDEAKAEVLKNRAQQLHREQQKGVQPLTFG

SEQ ID NO: 793536 - protein, 83 aa, Homo sapiens; identical to SEQ ID NO: 793535

SEQ ID NO: 793537 - protein, 196 aa, Homo sapiens
MVGFGANRRAGRLPSLVLVVLLVVIVVLAFNYWSISSRHVLLQEEVAELQGQVQRTEVARGRLEKRNSDLLLLVDTHKKQIDQKEADYGASAAGCRPERASGRDARMTRFTLQKQHIVSDRRHTSSHGANCSSFRRHSSPPRPPFTPIGRTHYTCESRTLCTLRGHTSGWPASDHSLHSRTAPHHPSPAPARLPPP

SEQ ID NO: 793538 - protein, 179 aa, Homo sapiens
MVGFGANRRAGRLPSLVLVVLLVVIVVLAFNYWSISSRHVLLQEEVAELQGQVQRTEVARGRLEKRNSDLLLLVDTHKKQIDQKEADYGGLSSRLQAREGLGKRCEDDKVKLQNNISYQMADIHHLKEQLAELRQEFLRQEDQLQDYRKNNTYLVKRLEYESFQCGQQMKELRAQHEEN

SEQ ID NO: 793539 - protein, 90 aa, Homo sapiens
MIDPETRHKAFLKAWPWQNSTITFVPGLAICHYSSVQVPRRGAILPMLYALCYVKMPSFQHGPGRMYHLTCDWPRKMSLSCHVCRAHFRD

SEQ ID NO: 793540 - protein, 93 aa, Homo sapiens
SWCGGVWSYDQHLRCQWMLQLLQGWPALPASLSCHLWAFTLCQVELRCHDLRKFMFPHFTEGESETEDCRNNKGGRSRCKPGRPTPACFPSGY

SEQ ID NO: 793541 - protein, 74 aa, Homo sapiens
YATWGFSRTYLTDGSDQFEPLTPEYPSRGNNQQRPCYFCGCLGILTEAWFNPELYTGWFKCFPADFGSNVLGHS

SEQ ID NO: 793542 - protein, 96 aa, Homo sapiens
TLKTGSDPRCSVDSGVAAGRATRTLASSVSSRPLLMAPHRQAELHLRSPPAAAEERRARPRPGRNPHSLCAPACLKDKVYLQRRDAHIKDNETPKC

SEQ ID NO: 793543 - protein, 384 aa, Homo sapiens
LLQFLSCLENGLLPHGQLDPPLWSQRGKGKVFPKLRKRSPQGSAESTSSDKDDDEATDYVFRIIYPGMQSEFVPQDLMDVSVSNLPSLWQPSPRKSSCSSCSQSGSADGSSTNGCNHERAPLKLLCDNMKYQILSRAFYGWLAYCRHLSTVRTHLSALVNHMIVSPDLPCDAGQGLTARIWEQYLHDSTSYEEQELLRLIYYGGIQPEIRKAVWPFLLGHYQFGMTETERKEVDEQIHACYAQTMAEWLGCEAIVRQRERESHAAALAKCSSGASLDSHLHRMLHRDSTISNESSQSCSSGRQNIRLHSDSSSSTQVFESVDEVEQVEAEGRLEEKQPKIPNGNLVNGTCSPDSGHPSSHNFSSGLSEHSEPSLSTEDSVLDAQ

SEQ ID NO: 793544 - protein, 104 aa, Homo sapiens
LLTKLFAPLHPPQSYEEQELLRLIYYGGIQPEIRKAVWPFLLGHYQFGMTETERKEVGYLPWALGSLATKGARYCGAGECWFHAGPRKGREIRGRWEPEGGAVQ

SEQ ID NO: 793545 - protein, 261 aa, Homo sapiens
LHTAVGVVSPCFRQPRDAVITIPKDLNTYTVILCGQLVKAGEELVEGHDQFLCSALGRQAGEALDVSKQDAHVVMFLDVNLMDHPKILLLGVDVCFHFPPGNMTGKDRQQEPFLLLVLPLRVEPRLDALSGLLESLSLGDLSRIVGADTHDVGAGENENIGDKLLQQELVLGVGAQGDGQVEGGQEHPAEHCGPHAHGQQRVDGVDEEHGPPDALRGAAWLRQQQAHHLDGQHHGDERIAGQAHVVLVEGGAVAKHSHDED

SEQ ID NO: 793546 - protein, 118 aa, Homo sapiens
HEGVRGVVVPPARKRLSLGDAALGDPRQAWDEGPLSPGPYQCRPSLPAQLYPQSLMAAATLRTPTQGTVTFEDVAVHFSWEEWGLLDEAQRCLYRDVMLENLALLTSLGKVLLPFPVP

SEQ ID NO: 793547 - protein, 91 aa, Homo sapiens
ERRWFRHSSCRSGGSSPASRRPGGPEKPRARRALPPRSRPEAARRRPGCPPATDGDVQKGPECPALRLVFFLSGACFCVLLRQFMCVICET

SEQ ID NO: 793548 - protein, 79 aa, Homo sapiens
LPPRSGTLDKSPPLSEPRVRAPSSTRWHPHQQVFMERLPFARRCGLAVQVPLWEEHENSLQILEQGQGLAEKNHSGFNR

SEQ ID NO: 793549 - protein, 285 aa, Homo sapiens
NHGAQPRATLGPAGAFRFLASFFPAPPAAGEAAGAQCLEVAPSPPLAAGTERRRRPEQGGRPEPRARPAPARNMATCGDRSSSGVSCCTADFLEQRKRLARRRRQVEPGPCGPGRGQHRHSHEAPGAALGANESHGNLQTAPQQPLGSAHTSLQVAPLALHLPRPPRGELRCQQGRADTGGPGPQQPRSPGALPGVTRRRRRCPRKRQELRARVPVPGMARSRRWRGGDGEGEAAGGKERRSTGGVNMRWLSLEYEEDEASQKERKREGAMTQQSTMQNPALGLQ

SEQ ID NO: 793550 - protein, 69 aa, Homo sapiens
VKGRVRWRQPAVSEEQHKTAEKLILRRQSQMARQKLLPNLLLTGAPDWTTIHTKKYLHENHNSGSYQAR

SEQ ID NO: 793551 - protein, 102 aa, Homo sapiens
MGGVWDWRRRVRAEAGGKLSPGQEDHARYPKGLNYFLWEVGIRLGFSRRGKDLGVTFCCPTRLAHRGHFLGVAHRLWRTAACVLSKGSHFRVPHFQVSSIWP

SEQ ID NO: 793552 - protein, 123 aa, Homo sapiens
PGFPGPCSLESQSPWVPRPQPWRLLLQRRPAGPWTRWTGSLGTPAGPAPSSLLASSSPHAVPSLGPQHSVPPLQEIGPMAGLGRRQGGGEPHLSNRVIGEAGARSSGARLLHGVKIGGWTAVG

SEQ ID NO: 793553 - protein, 113 aa, Homo sapiens
PRENSVCPHGKKKGSWQGHFCCKGDFTMQPLLKTTDVIDDDDDDDDDDDDDDHDHDHDDGDHDDGDEDGNDCRIWGRGSLKESTKQCPSNQSLFNADFSFFYGSVWGQVSQIT

SEQ ID NO: 793554 - protein, 195 aa, Homo sapiens
WSPLLRSRQHVSRGTQQPESPKVAGAEVAVSWPEVEEALVLLQLWANLDVLLVASWQELSRHVCAVTKALAQYPLKQYRESQAFSFCTAGRWAAGEPVARDGAGLQAAWRRQIRQFSRVSPAVADAVVTAFPSPRLLQQALEACSTERERMGLLADLPVPPSEGGRPRRVGPDLSRRICLFLTTANPDLLLDLGS

SEQ ID NO: 793555 - protein, 210 aa, Homo sapiens
WSPLLRSRQHVSRGTQQPESPKVAGAEVAVSWPEVEEALVLLQLWANLDVLLVASWQELSRHVCAVTKALAQYPLKQYRESQAFSFCTAGRWAAGEPVARDGAGLQAAWRRQIRQFSRVSPAVADAVVTAFPSPRLLQQALEACSTERERMGLLADLPVPPSEGGRPRRVGPDLSRRICLFPSWTRPPAFASHKLYSIFIKSLFHNFQKK

SEQ ID NO: 793556 - protein, 110 aa, Homo sapiens
WVTYLVHMSAGIILINGQLTMQSISRSILFPDRHGFYFLSAQLGRLVSAGLPSHGKPLITLSQYILWGPSTFPIKDNYTWPSAVANACNPRTLGSQGGWITKSGDQDHPG

SEQ ID NO: 793557 - protein, 103 aa, Homo sapiens
MEGHEQRGTLRTPDHTQCQSQKRKGPEQRNPPSQGSGQRGRGRGDLWTWGGRIHGCGEQDGGAGEREWDFMGAEFQFGREVLGWMVVTVAQPCKCTYCHWAVT

SEQ ID NO: 793558 - protein, 77 aa, Homo sapiens
GSKREPQLCNLPAYLGLSISHLKMRRPEIAAALPAVIISVTEQVYGDHQSVSGTLVDMGLALCVQTRALTARLTSQW

SEQ ID NO: 793559 - protein, 125 aa, Homo sapiens
MLECTETNSLGFILAFLYNGLLSISAFACSYLGKDLPENYNEAKCVTFSLLFNFVSWIAFFTTASVYDGKYLPAANMMAGLSSLSSGFGGYFLPKCYVILCRPDLNSTEHFQASIQDYTRRCGST

SEQ ID NO: 793560 - protein, 114 aa, Homo sapiens
PRQAPYALVSLPSAQLSSPSPTLPGALSLSMSPPPPLCTVPLSAAEPDPMRDPAGWGQGWAPSRRGQTLSFPVLAWELPLGIPSSATDFVGTGWGVGSRLHQEPGERVETPILE

SEQ ID NO: 793561 - protein, 97 aa, Homo sapiens
GGLKGLLKCAKAGAQAEETPRASEGCEDCQHTVTISVTWSQIIIRKTNQDRNSRESEKDKGPMAESLGILASSTTGLRQEIKQAQFNMSSQSIHRYC

SEQ ID NO: 793562 - protein, 125 aa, Homo sapiens
SGRFHTGSDMFKIWILKNLGNLRGSRTAAGPCWTVPVHVPGHGAGEPAHHPAMSPDSHLHTSMYFFLSNLSLPDIGFTSTTVPQMTVDIQSRSRVISYAGCLTQKSLFAIFGGTEERHAPECDGL

SEQ ID NO: 793563 - protein, 106 aa, Homo sapiens
PALLGYLAPGPGLSLPQLLNTRSLLRLAGLQNTLDLSASSVPLWSAAMTKLETVIITHILRQHRPDVGGSHQHFGRLRQADHLRSGVQHQPGQHGETLSLLKIQKN

SEQ ID NO: 793564 - protein, 124 aa, Homo sapiens
MAERWRPRGSEKGEGFPPHAGWPRPALPAWVPPLQLRRKLLDTPLFGRFHSNPVPGKMPKYYYNHPEERTIQVAVSLSVCNIHPVYVPSGPPKVLPVTACQSYVCPDASMCVCRATNKHADAEL

SEQ ID NO: 793565 - protein, 98 aa, Homo sapiens
AVAEDSDGREIKISQHSNYKNDVMIRKEAYVHKSMMEELKSIIDDSEITKEDDALWPPPNREGRQELEIIIGDEHISFTTSKIGSLIDVSQSKDPEGL

SEQ ID NO: 793566 - protein, 102 aa, Homo sapiens
FFLRGGSSAIASISIFHVWPKTILLPMWPREAKRLDSSDLDPPKKKTITSGAFCKFSLTELLLQEERLQYVNTPRQTFVTNHCLPCRSNRLYLRPLYVLQVH

SEQ ID NO: 793567 - protein, 46 aa, Homo sapiens
MVVVWSTGEESLRVLAFLVLSRVCRHKKDTFLGPVLKQMYIMYVRN

SEQ ID NO: 793568 - protein, 70 aa, Homo sapiens
VKHACFPFAFCHDYKFPEAFPAMLPVQPSELFDHMICFGRWNVSSWGPFCHHKSLDYPDGRWKTHGCCSS

SEQ ID NO: 793569 - protein, 113 aa, Homo sapiens
QEIQELIEAQTRAPGPCAEVRALPAPAAEPEPAWEEAPPERALELEGAPAKDQTNEELPEITEVPESIKRRLGRRVPAATPAPRGNLLLQAWMRVHSWASRLFAPNVLPGTGP

SEQ ID NO: 793570 - protein, 78 aa, Homo sapiens
LGPGRRKLQLSRERFVGQKLEVLKKLKDRASKGAGIYPESFRGRAWDNLSSNIKYIALSYNLKYKTAQSPCCYKYVIK

SEQ ID NO: 793571 - protein, 298 aa, Homo sapiens
MTLNTEQEAKTPLHRRASTPLPLSPRGHQPGRLSTVPSTQSQHPRLGQSASLNPPTQKPSPAPDDWSSESSDSEGSWEALYRVVLLGDPGVGKTSLASLFAGKQERDLHEQLGEDVYERTLTVDGEDTTLVVVDTWEAEKLDKSWSQESCLQGGSAYVIVYSIADRGSFESASELRIQLRRTHQADHVPIILVGNKADLARCREVSVEEGRACAVVFDCKFIETSATLQHNVAELFEGVVRQLRLRRRDSAAKEPPAPRRPASLAQRARRFLARLTARSARRRALKARSKSCHNLAVL

SEQ ID NO: 793572 - protein, 101 aa, Homo sapiens
KGAPMGPARTDQGQRLKGSYLKGNHPGGPEPLIFQTLQGMMLLPQSRAQARAEFGTREQERQGEEDSELSDRAVLLCSSWLLGIGFREYSAVLDALRHLRV

SEQ ID NO: 793573 - protein, 156 aa, Homo sapiens
MILQVSGGPWTVALTALLMVLLISVVQSRATPENSVYQERQECYAFNGTQRVVDGLIYNREEYVHFDSAVGEFLAVMELGRPIGEYFNSQKDFMERKRAEVDKVCRHKYELMEPLIRQRRGDVTITAVRGCWTTILSGYFLLKRGVVSGGCSWGSS

SEQ ID NO: 793574 - protein, 118 aa, Homo sapiens
TYKEWKAARFCCCTNGLPTEHRLPHPLLFQGVRFLKPSGDCDIVFFPPPMLFILSDLGARAELPAQYHPLGLVGLEKASGAGEVVSWLLQELQSSWWLRIDLCFVLGVLTLLSHVFRY

SEQ ID NO: 793575 - protein, 73 aa, Homo sapiens
RGTLRELNLLLQDEPRPRARSPPRSQPLCPIAFSISSARNALPTRANPDVPSATVGTLPSCGAFARLPQSPWL

SEQ ID NO: 793576 - protein, 106 aa, Homo sapiens
LDCTHPVEDGIMDAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 793577 - protein, 106 aa, Homo sapiens; identical to SEQ ID NO: 793576

SEQ ID NO: 793578 - protein, 106 aa, Homo sapiens; identical to SEQ ID NO: 793576

SEQ ID NO: 793579 - protein, 81 aa, Homo sapiens
NLEEMDKFLEIYNPPRLNHEEIETEQTNNSEIKRVIFKTAYKKKVQDQMNSQINSIRLSKKNQYQPYRNYSQKNTERGDLP

SEQ ID NO: 793580 - protein, 107 aa, Homo sapiens
DRNSWGPKIQLLQLHNHQLFIDLNDSQNAGTLVVSISPLYNPVRKVFYLSPFYRGGNKRSGKLNNFPKIAQLSVMDLGDKPTSHARCKVVLSPPSHEMSYRGKSFLS

SEQ ID NO: 793581 - protein, 241 aa, Homo sapiens
RLRQGCIQPCNLVPSTLESLEASALPPAVGDSGRYPLYQLLNCGRGNSCGAIHPDIAHMERLLQQAMAERERLLKAREGTRRGTEGSSGPAVPAITAPPTPPHPPGPRILDLRQHLEGWGHNPENCPHVQVSGCCCRGPLVKMGGRIKTWRKRWFCFDRQARRLAYYADKEETKLKGVIYFQAIEEVYYDHLRCAFKSPNPRLTFCVKTYERLFYMVAPSPEAMRIWMDVIVTAADENHAP

SEQ ID NO: 793582 - protein, 267 aa, Homo sapiens
GSGKGVSSPEPGPLYTESLEASALPPAVGDSGRYPLYQLLNCGRGNRRDIREKVGRWKKRPSHCNPPRLCSLPSCGAIHPDIAHMERLLQQAMAERERLLKAREGTRRGTEGSSGPAVPAITAPPTPPHPPGPRILDLRQHLEGWGHNPENCPHVQVSGCCCRGPLVKMGGRIKTWRKRWFCFDRQARRLAYYADKEETKLKGVIYFQAIEEVYYDHLRCAFKSPNPRLTFCVKTYERLFYMVAPSPEAMRIWMDVIVTAADENHAP

SEQ ID NO: 793583 - protein, 70 aa, Homo sapiens
MNPLTKVKLINELNEREVQLGVADKVSWHSEYKDSAWIFLGGLPYELTEGDIICVFSQYGEIVNINLMWD

SEQ ID NO: 793584 - protein, 114 aa, Homo sapiens
MVHHRILTVIYKPTPSSLFNRIGLLAVPHQMSSCYRSCTLAVPSTWNASFLTSFQFSSDDTLSVGPFLTTLFKIVAPSPYTYIYTHTHTHSLTHIYSTLSCPLCFYSVLSAYNI

SEQ ID NO: 793585 - protein, 107 aa, Homo sapiens
SPLPGCLEQGSAPDTPPPPQAAWSRALLESRKEHTPFLRLSELQSLASWCKCLSACHHHRVGWSVTGSAGVGKRTLGQKCKGDRAGTPHNHNSSELFLVLCGKMLGA

SEQ ID NO: 793586 - protein, 36 aa, Homo sapiens
MIPKNPLSNTTSLKAKGKPENSHSAKLGIKTNTTPK

SEQ ID NO: 793587 - protein, 67 aa, Homo sapiens
QEDQANQTLARYRKTVHELDDAEDRAGMAETALNKLRTRHRVAGKGITSVEIIQVSKTGTSKTLSEE

SEQ ID NO: 793588 - protein, 89 aa, Homo sapiens
QGHRGYTLNTAVRRPQKLQEDRWSLFLHAAESQILKLPSVHKAAQRRSVTVAAIWHRCSILTLYTSFGMQQVENYKPGSSPQVKSEKHY

SEQ ID NO: 793589 - protein, 78 aa, Homo sapiens
SPVPPRPPGAPPHSTSHAAESQILKLPSVHKAAQRRSVTVAAIWHRCSILTLYTSFGMQQVENYKPGSSPQVKSEKHY

SEQ ID NO: 793590 - protein, 75 aa, Homo sapiens
FPGLYEFGFRHTHGHASQCALAQSTPSSRNPPQPFAGVHTVQSTDFPNEPGGNVPGRTPGPEEPTESSTKKGREA

SEQ ID NO: 793591 - protein, 102 aa, Homo sapiens
AYLPPHRSTPSWGKACLAMAVQRRVLPNRMWFLKQTEAAHKAPSLASDTSLWLGARSSGAHSTGPGCTEVRVQWLTSIIPGLWEAEAGGSLERRSSRPAWTT

SEQ ID NO: 793592 - protein, 67 aa, Homo sapiens
VGECVRVRVSYVLIRAWGSEEGNPFGEGQPPNRTCCGKPHHDKEHVSARNMWASGPRKALWFPLSPQ

SEQ ID NO: 793593 - protein, 113 aa, Homo sapiens
MKLNERSLAFYATCDAPVDNAGFLYKKGGRHAAYHRRWFVLRGNMLFYFEDAASREPVGVIILVAVVSGRGPCLCLRGGSHRALQTLLDCILQSWPLGLGPLGSLPDLPSWAG

SEQ ID NO: 793594 - protein, 113 aa, Homo sapiens; identical to SEQ ID NO: 793593

SEQ ID NO: 793595 - protein, 302 aa, Homo sapiens
MKLNERSLAFYATCDAPVDNAGFLYKKGGRHAAYHRRWFVLRGNMLFYFEDAASREPVGVIILEGCTVELVEAAEEFAFAVRFAGTRARTYVLAAESQDAMEGWVKALSRASFDYLRLVVRELEQQLAAVRGGGGMALPQPQPQSLPLPPSLPSALAPVPSLPSAPAPVPALPLPRRPSALPPKENGCAVWSTEATFRPGPEPPPPTASPPGLGHPTGPWTWPPSPGCTSAMARRSGPCVASGSAAGSSPEATRAPVLGGHKLYALWDRPGPGETGGADPEGNHGQGWPPGPEWPGFGGCRL

SEQ ID NO: 793596 - protein, 116 aa, Homo sapiens
MKAVWSTEATFRPGPEPPPPTASPPGLGHPTGPWTWPPSPGCTSAMARRSGPCVASGSAAGSSPEATRAPVLGGHKLYALWDRPGPGETGGADPEGNHGQGWPPGPEWPGFGGCRL

SEQ ID NO: 793597 - protein, 302 aa, Homo sapiens; identical to SEQ ID NO: 793595

SEQ ID NO: 793598 - protein, 151 aa, Homo sapiens
DRNNITRITKMDFAGLKNLRVLHLEDNQVSVIERGAFQDLKQLERLRLNKNKLQVLPELLFQSTPKLTRLPSVELCWMALDRNHIPPTGFLQSTCSWSNYYEEDREGLENLVPVAFETCTITLQLSTLTKYQDQLCFLKDQIKSNFKWDKR

SEQ ID NO: 793599 - protein, 108 aa, Homo sapiens
MLVNLMISKEVNVAGAGVESGEEKDRRRKDKWLQKIILGLVKHGEDFGLESGSELESHFYCLLTMDKPLTSLSISFLACKIKKIYSGQARWLMPVIPAPRGGRGGRIT

SEQ ID NO: 793600 - protein, 115 aa, Homo sapiens
WKILYQDKWYTLQSHPCCAPSPLPTPQGTQQLLILWKGPTACRNLPLLVTVLRFVNGISTFPKNDQLPSCSQECQSDFAFEASSLSEHDCIKVRSWLWSTEKATAAQRLMVWAGP

SEQ ID NO: 793601 - protein, 60 aa, Homo sapiens
MFTESKSTGIGIEYVGGEHVKSVVKTESRNDTQSARPAMGTLTFKTFLLISENLQPSRGY

SEQ ID NO: 793602 - protein, 117 aa, Homo sapiens
LNLSVAAFDCLSANCFPVESYCSCSNHPVPALDTEYIKGSTKQLLPKNSQPTFLSLNDGHSPYGRSNIFLIFLCWFEIRTELDILSKLEGTSFTDNRNLEDLGFRTMLFKFNNWKIS

SEQ ID NO: 793603 - protein, 120 aa, Homo sapiens
SVVSLALCPESQGRASHAVGCPLPNPGDEATFHSEPGSAFPGRGGEESRSRECRWGRDQGLRVRKEACGPRQGESVYPSLGRCPKERDGLGEQVMAMRAGAGMGSDCKWAMISFQERKTF

SEQ ID NO: 793604 - protein, 121 aa, Homo sapiens
SDKDSHVPPRLTWILLNPTPAFSRSLGSRRPWGPTVISAVPAARHSHSNSPNHDAQNATSKKNIRALPLRKNSCTYKEEGTAQPSTFQLLSFHLHPSTLIRTYMKLCDIFLFLLNKIQLSS

SEQ ID NO: 793605 - protein, 358 aa, Homo sapiens
GPPQPQKKLDPDSIPSPIQVIENDRASRGGQVYATNTRGQIPPLVTTDCMIQDQGNASPRFIRCTTYCFPCTSDMAKQAQIPLAAVIKPFATIPSNESPLYLVNHGESGPVRCNRCKAYMCPFMQFIEGGRRYQCGFCNCVNDVPPFYFQHLDHIGRRLDHYEKPELSLGSYEYVATLDYCRKSKQPTRTDPREYLMCHLFAHINTDMTLLAESGKTHTLNNSDDNGYYPTKEAIFNEAHNCKQREQPGNGLPERFRLTTTKDFTGSFLTVEFPLVVFTRRICRVPNQWNALPVLDVRSHREKPLLGPIQKQQEARGRNTNTPRERLTHRGGKHRDGPGTLGAQTRGAQQTTPEQKKA

SEQ ID NO: 793606 - protein, 97 aa, Homo sapiens
REGRKHLCWGLLPLPQHWGITAFLAAATYHKISSAGEERMCSSQATGPLCLAPSTELPKGLTFATLELTSRGPLAYPFPCQLKRLPAAWTSWLAEGS

SEQ ID NO: 793607 - protein, 107 aa, Homo sapiens
TGCGGSRCLFCMARVPHRSQLSVCTCSDLHHSCPAPAVTTWNLQPGLGGCEVSREVDQEATPFCGTSEMTTCFTVGWGWGRKERPHYSRTFYPHRLRHPVMKSPRTA

SEQ ID NO: 793608 - protein, 828 aa, Homo sapiens
MQNRTQGQTVFVRIPALLHTSCVTSGYTVRLLKFLFFFFFFFEMEFQFLLPRLECNGEITAHCNLHLLSSRDSPASPSRVTGITGAHLHTQLIFVFLVVTGFHHVGQAGLKLLTSSDPPALASQSAGITGVSHPELAVHKVLRTCSMFTFQRIKGIHHFFFDLSILCSFRFQTAIKTSSTGEYNPRPPFPGNLDIELLLFSILGSCYAVMLTSEENSERSVHILFADLPAVLRDWSVAELTYLPYLQNSQVPRLHFPFSYKTQTLFLGPITHRNPTQHLSHWNLEEHLPKDYISSILLPFIIKSLLDGDDLNSLGACFLSCESFLGVNSEINLSLFLFLFIYFLRWTLTLSPRLECSGTISAPCNLHLPGSSDSPVSATQVAGTTGAHQHARLIFVVLVDTGFHHIGQAGLKLLTSNDPPTLASQSAGIIGVSHHALLKLIDFFQVCAVMFYFCDQTYFKSYKDSFQLYLMKASRHLMTFFSGVIVFIFCAFIFGKPVLLSVCLLISKVLLNLHYLKCPLPINFSSTLRLNIFLSGYLYIFRTFYCLKITVKASKNIHPKISQFQYPTTQRRAHGCSSPSGAHSTSEDPALKRPLAHPPAHHMLSHRFYTFIYLFIYLVRWSLALLPRLEYSGAVSAHRKPCLLGSSNSVAASRGAGITGTHHPIQLIFVFLIETGFHHVGQAGLKLLTSGDPPTSASKSAGIIGVSHCSRALMLLKFSLYLNYLEFILCLYIIWREFTEEHMYPPNCNAILAIYQIIMSILVNFCTVYSIPLSSYLFIHKYQTFYYYTLKYYYETHLVRPPLYFPTVSEFFKGSFFPMHTLESYCLF

SEQ ID NO: 793609 - protein, 584 aa, Homo sapiens
PSAMRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 793610 - protein, 543 aa, Homo sapiens
PSAMRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 793611 - protein, 502 aa, Homo sapiens
PSAMRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 793612 - protein, 96 aa, Homo sapiens
AKSAQTLKQEKTVSRATWKGSSICFQAKASLQKPLGSSLCVSPLLPCTPDCRQASGEVANSWDPPVKSLLSARDVKRLGLSPIGRWGALSLTLPGK

SEQ ID NO: 793613 - protein, 111 aa, Homo sapiens
VGNERRVPSKHCGSRKPRDSRRRTSLSNMERIQYLFSGKSKPPKAPWFFSVCLAPSALYTRLPASKRGGGEQLGSSSEKFAQRERCQEAGIVAYREVGSSLTHTSWEMKEN

SEQ ID NO: 793614 - protein, 303 aa, Homo sapiens
MCAEVGPALCRGMERNSLGCCEAPKKLSLSFSIEAILKRPARRSDMDRPEGPGEEGPGEAAASGSGLEKPPKDQPQEGRKSKRRVRTTFTTEQLHELEKIFHFTHYPDVHIRSQLAARINLPEARVQIWFQNQRAKWRKQEKIGNLGAPQQLSEASVACPQIWMWLGPRGHPLLCAGWLLPRAVVHRLKISWPLPGSLPGSPSSQRTHGKHSLSQVFPSIKLASLCYASFHLHTPNGAASVLLQHRDWTCSPQMSHFPLQVKAGSRCALGLWGNRFHNPKMAHSPGSYPEHASWKAAPDSKAN

SEQ ID NO: 793615 - protein, 93 aa, Homo sapiens
SGEREREEAREERARGCSEASRTSSDSGPSRAPAARVVGGEAAATAAARARPRAPLAAGSPVPVRPQDAAARSAAGMQPGHGRRPPVTCRGER

SEQ ID NO: 793616 - protein, 93 aa, Homo sapiens; identical to SEQ ID NO: 793615

SEQ ID NO: 793617 - protein, 117 aa, Homo sapiens
PAIFAVPSSCMWPATLILDGAALEDFPPRKGGFFLPTGARSIWSGCLQAAECVLCLSQSLSPLCLPLHQPALPSGALPSLDSLCQVWTRLGHVPLEFSPSQPLSVGFSPWTQEEDPQ

SEQ ID NO: 793618 - protein, 102 aa, Homo sapiens
MRLHPGSNSYLQRALPVLLGIQVSASPPRSMMNAGRHPCEEPCDHFPFLKIPGGGGPWPTSALTTPGSDLARCLRCDGNFSTLNFASDPDEIASVAFASRSC

SEQ ID NO: 793619 - protein, 86 aa, Homo sapiens
PYFLIPAAVEWIFNKQPTAARDRSSGTVFLSEKSESYQRVGHLDWQDTLGLFITGENEVSRETNRNKEYELPQTELPSTILKDFCV

SEQ ID NO: 793620 - protein, 80 aa, Homo sapiens
QAVSGTACPSGSVRHCAYWAAASCPPSAPSAAARALRPATAPPPEAISGSPATDSARMHRPTDRPQCPPRAVAELPTPTP

SEQ ID NO: 793621 - protein, 140 aa, Homo sapiens
MLALQLQEILCTLTLLSQFVEEVASAFQCHIIVVKIEAQNERDVGGLQIQIDQAIDSCLQLDEIILMSLVCKKELTTKTVLAGLRSRRWPRRWSWRLQVERTVEGSWRLEERESLGLFHPNTIEARDRWVGLSNALPEHP

SEQ ID NO: 793622 - protein, 93 aa, Homo sapiens
GYLHSAHESHRGDRGPQAPSDTSTPHNAFLGYTPPTWPAQGIRSCVEESAGGGRAPGNNHGSLADKPCAHTAQALTPAAGGALLGSGPRIRAK

SEQ ID NO: 793623 - protein, 202 aa, Homo sapiens
EGVPRGAPLETLLILGVRLTAGRDLSRNLSPLTEPSLRSVHGLLLDTARIQKSMLSILKPRRSQEWRTALRRYCCPTDLQAPRSPVPPIRKVGISDVIVHANLATSLKKNTCNCQADLLSWRSWVNGISCHCPNLRPLSKSIFRDSTSLCSLSQQRLCPLHSKPEACWGLFISVHAHFRVQSGGRGNRVGKKTRVSRNDETL

SEQ ID NO: 793624 - protein, 104 aa, Homo sapiens
GVAEASAGRSSPVRRNGLGSCLKKQSGHDRIEQLCSVGGGTFLVWTVWTLQSWQAGTAESTNLQRWWPPSPGSPVPGRDRSSVLITLTGVAKASTGISVFFASK

SEQ ID NO: 793625 - protein, 173 aa, Homo sapiens [sequence omitted]

SEQ ID NO: 793626 - protein, 211 aa, Homo sapiens
PVHFPRVPRSPTRGMSSAPAPGPAPASLTLWDEEDFQGRRCRLLSDCANVCERGGLPRVRSVKVENGVWVAFEYPDFQGQQFILEKGDYPRWSAWSGSSSHNSNQLLSFRPVLCANHNDSRVTLFEGDNFQGCKFDLVDDYPSLPSMGWASKDVGSLKVSSGAWVAYQYPGYRGYQYVLERDRHSGEFCTYGELGTQAHTGQLQSIRRVQH

SEQ ID NO: 793627 - protein, 197 aa, Homo sapiens
MSSAPAPGPAPASLTLWDEEDFQGRRCRLLSDCANVCERGGLPRVRSVKVENGVWVAFEYPDFQGQQFILEKGDYPRWSAWSGSSSHNSNQLLSFRPVLCANHNDSRVTLFEGDNFQGCKFDLVDDYPSLPSMGWASKDVGSLKVSSGAWVAYQYPGYRGYQYVLERDRHSGEFCTYGELGTQAHTGQLQSIRRVQH

SEQ ID NO: 793628 - protein, 203 aa, Homo sapiens
PVHFPRVPRSPTRGMSSAPAPGPAPASLTLWDEEDFQGRRCRLLSDCANVCERGGLPRVRSVKVENGVWVAFEYPDFQGQQFILEKGDYPRWSAWSGSSSHNSNQLLSFRPVLCANHNDSRVTLFEGDNFQGCKFDLVDDYPSLPSMGWASKDVGSLKVSSGAWVAYQYVLERDRHSGEFCTYGELGTQAHTGQLQSIRRVQH

SEQ ID NO: 793629 - protein, 86 aa, Homo sapiens
KLDLRLLVTHLPQGPELCVLPLGFLCEMHRSQDSLGTCHSGAGSEASSPWFLGLCRERTGLETPSPGCFHTFKHHGFLPSLRPQWP

SEQ ID NO: 793630 - protein, 143 aa, Homo sapiens
LRLSLALPPTLVCSGVISTHCNLRLPGSSNSPASASQVAGITGTRHHAQLIFALLVESGFHRVGQAGLELLTSGDPPASISQSAGITGMSHRTQPCSTFNSSDYMGNPNSLNLETQVDNPCFKNLMSQCFFSVLTWLMPLSYS

SEQ ID NO: 793631 - protein, 115 aa, Homo sapiens
IDKSYDGPEEIEADGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGG

SEQ ID NO: 793632 - protein, 135 aa, Homo sapiens
PARQPESINLKASKSMDLVPDESKVHSLAGQKSDGLSDKSSHSGQGALNCESAPQGNSELEDMENKARKVKKTKEKEKKKEKGKLKVKEKKRKEENEDPERKIKKKGFGAMLRFGKKKEDKGGKAEQKGTLKHGG

SEQ ID NO: 793633 - protein, 85 aa, Homo sapiens
PLTPRALQGGAAAAWGVLSCPVCISRRTLGGPYGKALSPKLHLGGPGAGQLTPGPRLSLWSAWFCCPQWEGAWGPRRCRPCLPIY

SEQ ID NO: 793634 - protein, 125 aa, Homo sapiens
DRGGGSFMNGLAPSLWCCSHDGVLMRSDCLKVCSTAPHSLSSSALATSAVPAARSPSAMIVSFLRTPRKQMLSCFLYNLQDHEPIKPLFFIKCLLGIFYSSAKWTNTISMGGHTRNKHNWCLRKE

SEQ ID NO: 793635 - protein, 357 aa, Homo sapiens
LGPLARQAGRLRGATPLAAGMETMRAQRLQPGVGTSGRGTLRALRPGVTGAAAATATPPAGPPPAPPPPAPPPPPLLLSGAPGLPLPPGAAGSPAVLREAVEAVVRSFAKHTQGYGRVNVVEALQEFWQMKQSRGADLKNGALVVYEMVPSNSPPYVCYVTLPGGSCFGSFQFCPTKAEARRSAAKIALMNSVFNEHPSRRITDEFIEKSVSEALASFNGNREEADNPNTGIGAFRFMLESNKGKSMLEFQELMTVFQLLHWNGSLKAMRERQCSRQEVLAHYSHRALDDDIRHQMALDWVSREQSVPGALSRELASTERELDEARLAGKELRFHKEKKDILVLAAGQLGNMHSSNC

SEQ ID NO: 793636 - protein, 113 aa, Homo sapiens
EDHMRTQGEDSHLQAKERGLRRDHLYRHLDLRFLIPRIVRKSMSVVIQSKVLCCGSPSKLVLIQSTCPVAQQTHPEYVSPEMHKYVHPKTCPVIVRVVPNWKLLKYENYGMHK

SEQ ID NO: 793637 - protein, 109 aa, Homo sapiens
QWEELRAEPLTRRMKLSPGCRDLGPLSKRAAWAGTQGSHGPIPMTQDTPHPVVTLAPHGFPALQSWSRPRASYPGSCGQRCSPAPRRRDSGHSRAVRGSGQDTLDSAPQ

SEQ ID NO: 793638 - protein, 135 aa, Homo sapiens
RGAAGWRWAPRRRGQSLGLLVLLVLHAPVLEPDLDLPLAEVQQVGHLYTARPAQVAVKMELLLQLHQLRARVRRPRPLGRRRPRGALVPSPAAAATAPAATTASAAAATAAATTALCWIRGGGVGRGENEIKDNY

SEQ ID NO: 793639 - protein, 125 aa, Homo sapiens
VSRRKVSRHIVREEEAAVPAPGTTGITSHGHICAPGAPAQQVYLQETGNWKEGQEQLLRYQLAGQNQLLLLCPDFRQERQQLPGQSRLSKQSGSLGLSREKKASCGATEAFCLHSVHPETIQEQL

SEQ ID NO: 793640 - protein, 125 aa, Homo sapiens; identical to SEQ ID NO: 793639

SEQ ID NO: 793641 - protein, 77 aa, Homo sapiens
RSHVGLENECKVLLSESSSQQMREPEGRWFSPGVWLLGGPGSPPATLAKLHLVLLVDGLLACWHLSVCFSAGMLPSM

SEQ ID NO: 793642 - protein, 187 aa, Homo sapiens
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 793643 - protein, 223 aa, Homo sapiens
QLVPREYGYRRPRASPPNLTARSAVTSGLGGPPAAVMVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 793644 - protein, 187 aa, Homo sapiens; identical to SEQ ID NO: 793642

SEQ ID NO: 793645 - protein, 187 aa, Homo sapiens; identical to SEQ ID NO: 793642

SEQ ID NO: 793646 - protein, 107 aa, Homo sapiens
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDAFDVVLFQRKP

SEQ ID NO: 793647 - protein, 187 aa, Homo sapiens; identical to SEQ ID NO: 793642

SEQ ID NO: 793648 - protein, 187 aa, Homo sapiens; identical to SEQ ID NO: 793642

SEQ ID NO: 793649 - protein, 187 aa, Homo sapiens; identical to SEQ ID NO: 793642

SEQ ID NO: 793650 - protein, 187 aa, Homo sapiens; identical to SEQ ID NO: 793642

SEQ ID NO: 793651 - protein, 187 aa, Homo sapiens; identical to SEQ ID NO: 793642

SEQ ID NO: 793652 - protein, 206 aa, Homo sapiens
NSVTGPGAMRVLVSPPAAVMVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 793653 - protein, 187 aa, Homo sapiens; identical to SEQ ID NO: 793642

SEQ ID NO: 793654 - protein, 168 aa, Homo sapiens
FFQLSDWIKIGDLTSKNCHLFVNLQSKGLKGGGRFGQTTPPLVDFLKDILRRYPEGGQILKELIQNAEDAGATEVKFLYDETQYGTETLWSKDMAPYQGPALYVYNNAVFTPEDWHGIQEIARSRKKDDPLKVGRFGIGFNSVYHITDVPCIFSGDQIGMLDPHQTLF

SEQ ID NO: 793655 - protein, 119 aa, Homo sapiens
FFQLSDWIKIGDLTSKNCHLFVNLQSKGLKGGGRFGQTTPPLVDFLKDILRRYPEGGQILKELIQNAEDAGATEVKFLYDETQYGTETLWSKDMAPYQDVPCIFSGDQIGMLDPHQTLF

SEQ ID NO: 793656 - protein, 96 aa, Homo sapiens
KWQVLIRPCSKVTVRFLTVMVKHGHIGEFEITDYHRAGKIVVNLTDRPNNCGVISPKCDVHLKDPEKSQNNLLPSCQFGFIVLTTSAGIMDHEKGS

SEQ ID NO: 793657 - protein, 118 aa, Homo sapiens
PVSQDSTVSQEENSKEDKMVTVCPNTESCESITLKDVAVNFSRGEWKKLEPFQKELYKEVLLENLRNLEFLDFPVSKLELISQLKWVELPWLLEEVSKSSRLDIHGAVKKMQMFSEAE

SEQ ID NO: 793658 - protein, 109 aa, Homo sapiens
AAGETLRREALGALVPGRGGSRAGRRRRGPRPCARGWQLPKLWASRTPSPSWSSRIRGSEAGGPRSSFLLPGAMPRAGGRACPRRSRRGPPLAWALTGVVNGVGICGSR

SEQ ID NO: 793659 - protein, 111 aa, Homo sapiens
SSWTISSFFLLEGAPLMCFMKIAHLYPEAKSLTSTCSLLSHLTYPMGQQVLIVLPPKRLSINSFQGRKRKRERKRERRKDGRKERKKEERKREKERKERKKRKKERKKERE

SEQ ID NO: 793660 - protein, 75 aa, Homo sapiens
QAAGLLSLRAPTPLNPQRKMQVCSLPGLPGLLSLRWGHPSTSSPGATLGPIQALRAQRLPGSSVTNIFPRQAGPK

SEQ ID NO: 793661 - protein, 859 aa, Homo sapiens
MGYIRPSSGTRASFFVAQQTAEVTPGCGSTSRGTKAGLLSCLQGRPFQTKWPAAPRTQLAPGCDSTSRGRCLATGQRGPATPDFLSRSPKDRAATAGQRRLHSSGEMAAGSTTLHAVEKLQVRLATKTEPKKLEKYLQKLSALPMTADILAETGIRKTVKRLRKHQHVGDFARDLAARWKKLVLVDRNTRPGPQDPEESASRQRFGEALQDQEKAWGFPENATAPRSPSHSPEHRRTARRTPPGQQRPHPRSHSREPRAERKCPRIAPADSGRYRASPTRTAPLPMPEGPEPAAPGKQPGRGHTHAAQGGPLLCPGCQGQPQGKAVVSHSKGHKSSRQEKRLLCAQGDWHSPTLIREKSFGACLREETPRMPSWASARDRQPSDFKTDKEGGQAGSGQRVPALEEAPDSHQKRPQHSHSNKKRPSLDGRDPGNGTHGLSPEEKEQLSNDRETQEGKPPTAHLDRTSVSSLSEVEEVDMAEEFEQPTLSCEKYLTYDQLRKQKKKTGKSSTTALGDKQRKANESKGTRESWDSAKKLPPVQESQSERLQAAGTDSAGPKTVPSHVFSELWDLSEAWMQANYDPLSDSDSMTSQAKPEALSSPKFREEAAFPGRRVNAKMPVYSGSRPACQLQVPTLRQQCAQVLRNNPDALSDVGEVPYWVLEPVLEGWRPDQLYRRKKDNHALVRETDELRRNHCFQDFKEEKPQENKTWREQYLRLPDAPEQRLRVMTTNIRSARGNNPNGREAKMICFKSVAKTPYDTSRRQEKSAGDADPENGEIKPASKPAGSSHTPSSQSSSGGGRDSSSSILRWLPEKRANPCLSSSNEHAAPAAKTRKQAAKKVAPLMAKAIRDYKRRFSRR

SEQ ID NO: 793662 - protein, 247 aa, Homo sapiens
DPRKQPRDSNTRTALLRALRRHACVRLTLKHREIRLQGRAAAFTPKDYVSRKTLRRRPYHGAASVCFVLSAPSSGCARRIHRYRGGSAPWAAGGAAAVALGPEEAAALPSQDSALPQERNQKEDLSALEILKVMSLGSELFRDVAIVFSQEEWQWLAPAQRDLYRDVMLETYSNLVSLGLAVSKPDVISFLEQGKEPWMVERVVSGGLCPGAKGQRGRDAGCACCKRTEQNPGQLWKMTESGLFFMH

SEQ ID NO: 793663 - protein, 179 aa, Homo sapiens
DPRKQPRDSNTRTALLRALRRHACVRLTLKHREIRLQGRAAAFTPKDYVSRKTLRRRPYHGAASVCFVRLRHLPAAHGESTGTVVEARPGLPGARPRWHLDPRRRQVRGSGAFQALWGPAGAGARAGWVSGLRRTQTSRLIVALWLYRRETTFPAGPRGVRFLAPPFCFQPHSPGAWTP

SEQ ID NO: 793664 - protein, 305 aa, Homo sapiens
DPRKQPRDSNTRTALLRALRRHACVRLTLKHREIRLQGRAAAFTPKDYVSRKTLRRRPYHGAASVCFVLSAPSSGCARRIHRYRGGSAPWAAGGAAAVALGPEEAAALPSQDSALPQERNQKEDLSALEILKVMSLGSELFRDVAIVFSQEEWQWLAPAQRDLYRDVMLETYSNLVSLGLAVSKPDVISFLEQGKEPWMVERVVSGGLCPVLESRYDTKELFPKQHVYEVESPQWEIMESLTSYGLECSSFQDDWECRNQFDRQQGNPDRHFHQMIIRHEEMPTFDQHASLTFYQKIHTREKPFG

SEQ ID NO: 793665 - protein, 179 aa, Homo sapiens; identical to SEQ ID NO: 793663

SEQ ID NO: 793666 - protein, 219 aa, Homo sapiens
SSLREEQQNSVVLEDLLENMEADTFATLCSQELRLASYLARMAMVPGATLRRLLSVVLPTASQPQLLALLDSATERHVDHAAESDGGAEQADVGRRRKHQSWWQALDGKLRGDLISRGLEKMLWARKRKQSILKKTCLPLRERMIFSGKGSWPHLSLEPIGELAPVPIVGAETIDLLNTGEKLFIFRNPKEPEISLHVPPRKKKNFLNAKKAMRALGMD

SEQ ID NO: 793667 - protein, 97 aa, Homo sapiens
SGPGRWKSYSLLKNPQGIRPDPLQVTESKALSSWESGWKEGHCRAAQVSGEATQEHLNPCPEKKRLQLSCTFLGTGSPSAQGFCSDRQREETRMVAS

SEQ ID NO: 793668 - protein, 111 aa, Homo sapiens
MRRLLLLVMSGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 793669 - protein, 111 aa, Homo sapiens; identical to SEQ ID NO: 793668

SEQ ID NO: 793670 - protein, 62 aa, Homo sapiens
MLGSAVSSSFPLSGSGGCKPRFKASAGVVSSEASPRGLQMAAFFLHPHVVPPLHSSILNVSL

SEQ ID NO: 793671 - protein, 134 aa, Homo sapiens
VLLKHGAKGSPLPAMGAGAEAALTAAEGCTRKALSLDVHSSRSEPQAALRLRPQSAPVREGKEGQESKERASSASIHARLPGYCLLVSMSPGVAFPAYKSRDSLKRRKGRNVFTRFDCHVIELYHLRNKCHWFS

SEQ ID NO: 793672 - protein, 101 aa, Homo sapiens
GLHLRPSFSQMLPPVIYPKLLPHGLFGPVTTFSFVFLCLYTSYSDHNVLSSLSSTGKIPSHPCRTSSLFHSLLKLPHILRAPHPPSAFGPHLHFRTPSTVF

SEQ ID NO: 793673 - protein, 153 aa, Homo sapiens
LLFWGRHESAELRDEEELEPAEAVHSPASVAQWAEARECLTILQMPTLWPAARPPPPQWPYGHRRPFMGLWPWQDPGPPDVRAAHALGTSCLQDRGAWSVCPSSARTQHCPRGWDHCKLETLLGDMCHFGHHPQSVTTWLGNFWSHSRHHGVT

SEQ ID NO: 793674 - protein, 229 aa, Homo sapiens
AAALPGGQGAMALSWLQRVELALFAAAFLCGAVAAAAMTRTQGSFSGRCPLYGVATLNGSSLALSRPSAPSLCYFVAGASGLLALYCLLLLLFWIYSSCIEDSHRGAIGLRIALAISAIAVFLVLVSACILRFGTRSLCNSIISLNTTISCSEAQKIPWTPPGTALQFYSNLHNAETSSWVNLVLWCVVLVLQVVQWKSEATPYRPLERGDPEWSSETDALVGSRLSHS

SEQ ID NO: 793675 - protein, 86 aa, Homo sapiens
AAALPGGQGAMALSWLQRVELALFAAAFLCGAVAAAAMTRTQRCYRAAHCTGHLSYSRLPGLGVCLYPSIWHQVSLQLHHLLEHYN

SEQ ID NO: 793676 - protein, 165 aa, Homo sapiens
AAALPGGQGAMALSWLQRVELALFAAAFLCGAVAAAAMTRTQGSFSGRCPLYGVATLNGSSLALSRPSAPSLCYFVAGASGLLALYCLLLLLFWIYSSCIEDSHRGAIGLRIALAISAIAVFLVLVSACILRFGTRSLCNSIISLNTTISCSEAQKFHDTQRHLH

SEQ ID NO: 793677 - protein, 195 aa, Homo sapiens
GSGASWWSGRHGAVLAAARRACALCCRLPVRGRGGRGDDSDPAGASGLLALYCLLLLLFWIYSSCIEDSHRGAIGLRIALAISAIAVFLVLVSACILRFGTRSLCNSIISLNTTISCSEAQKIPWTPPGTALQFYSNLHNAETSSWVNLVLWCVVLVLQVVQWKSEATPYRPLERGDPEWSSETDALVGSRLSHS

SEQ ID NO: 793678 - protein, 150 aa, Homo sapiens
AAALPGGQGAMALSWLQRVELALFAAAFLCGAVAAAAMTRTQGSFSGRCPLYGVATLNGSSLALSRPSAPSLCYFVAGASGLLALYCLLLLLFWIYSSCIEDSHRGAIGLRIALAISAIAVFLVLVSACILRFGTRSLCNSIISLNTTIR

SEQ ID NO: 793679 - protein, 150 aa, Homo sapiens; identical to SEQ ID NO: 793678

SEQ ID NO: 793680 - protein, 154 aa, Homo sapiens
AAALPGGQGAMALSWLQRVELALFAAAFLCGAVAAAAMTRTQGSFSGRCPLYGVATLNGSSLALSRPSAPSLCYFVAGASGLLALYCLLLLLFWIYSSCIEDSHRGAIGLRIALAISAIAVFLVLVSACILRFGTRSLCNSIISLNTTIRPLLG

SEQ ID NO: 793681 - protein, 229 aa, Homo sapiens; identical to SEQ ID NO: 793674

SEQ ID NO: 793682 - protein, 215 aa, Homo sapiens
AAALPGGQGAMALSWLQRVELALFAAAFLCGAVAAAAMTRTQGSFSGRCPLYGVATLNGSSLALSRPSAPSLCYFVAGASGLLALYCLLLLLFWIYSSCIEDSHRGAIGLRIALAISAIAVFLVLVSACILRFGTSCSEAQKIPWTPPGTALQFYSNLHNAETSSWVNLVLWCVVLVLQVVQWKSEATPYRPLERGDPEWSSETDALVGSRLSHS

SEQ ID NO: 793683 - protein, 185 aa, Homo sapiens
AAALPGGQGAMALSWLQRVELALFAAAFLCGAVAAAAMTRTQGSFSGRCPLYGVATLNGSSLALSRPSAPSLCYFVAGASGLLALYCLLLLLFWIYSSCIEDSHRGAIGLRIALAISAIAVFLVLVSACILRFGTRSLCNSIISLNTTISCSEAQKIPWTPPGTALQFYSNLHNAEVRPKDRRKN

SEQ ID NO: 793684 - protein, 67 aa, Homo sapiens
GEKEINIYFGDHHITHSNCIQFLLEALEEDPSCLSQLLGAPGIPGLVATSLQSLPLSTRGLLLCVCV

SEQ ID NO: 793685 - protein, 143 aa, Homo sapiens
TFVQHYECDDCGMAFGHVSQLTGHQKIHKVGETHEYGENTRGFRHRSSFTMLQRICTLYKHFECNQCGETFNRPSKVIQHQSMHSGLKPYKCDVCQKAFRFLSSLSIHQRFHVGNRVNLTRHQKTHTQRKPFSCNFCGKTFHR

SEQ ID NO: 793686 - protein, 145 aa, Homo sapiens
SDSTPSSKGASPPKQEIWLSAFTLLSCVTLSKWPTLSGLPESVATQRKVRCLLRDSPAVTGQGFDPSHFCSVVGDLSGGAGRGELSRTKSPQDTGHPGGLCFHSLFTPSCTRLPLPTALLPTLPTPQPPPLSRAESKRLPWGLAR

SEQ ID NO: 793687 - protein, 117 aa, Homo sapiens
AAVIIQDTKHLAQCLHVESGLYLCPDARAALSQCGSSPCTPWGPPTPQQSELVVGQRSGEEVWPCGMAAEPLSVPGPILRVVGSGLYPFLGLEQPRRPSPEAETLCPSGRNLRTLDP

SEQ ID NO: 793688 - protein, 81 aa, Homo sapiens
PPAAVSSRYYYPHFADEKTMSERSGDSRTNPGLCGSKAQALSWAEKTALSQGKAAPPNMETAGMLLRLSSGELQGSCNPVL

SEQ ID NO: 793689 - protein, 77 aa, Homo sapiens
IFMIHVHPVLLAKALYRKAPWPSQKVQGQEPGHLDSRSACGRFGTLLVGGGLKFSVMWQVPSVEDFTILHTSSHLAF

SEQ ID NO: 793690 - protein, 337 aa, Homo sapiens
TIIIVGLTLVEVLGYMSLLRFQTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLQNRMGHQPPPPTQQHSITDNSLSLKTPPECLVTPLPPSADDNLKTPPECLVTPLPPSADDNLKTPPECLVTPLPPSADDNLKTPPECLFTPLPPSADDNLKTPPECLVTPLPPSADDNFHPQRMIISRHVPSVCSIPFHPQRMI

SEQ ID NO: 793691 - protein, 87 aa, Homo sapiens
KGEKSHTLIFAKSKPWKTALFLTAPELPAGHLLQLPADLNQQPPRPHLKSSSPRFTLGRPPLGLSLRLQLTLVQLVSLPHSTRKCFP

SEQ ID NO: 793692 - protein, 71 aa, Homo sapiens
RETAKVPPPSLALCPGRPAGISSPARSAAPGASQTFQARGHPDVHTRPGPRGETQGPGLRRLSSLGGSERK

SEQ ID NO: 793693 - protein, 108 aa, Homo sapiens
MTRKIFTNTRERWRQQNVNSAFAKLRKLIPTHPPDKKLSKNETLRLAMRYINFLVKVLGEQSLQQTGVAAQGNILGLFPQGPHLPGLEDRTLLENYQVPSPGPSHHIP

SEQ ID NO: 793694 - protein, 197 aa, Homo sapiens
DPDTKLIGNIALLPIRSQFKGPAPRETKDTDIVDEANYYFKANVFFKNYEIKNEADRTLIYLTLYISECLKKLQKCNSKSQGEKEMYTLGIISFPIPGEPGFPLHAIYTKPANKQEDEVMRAYLQQLRQETGLRLCEEVFDPKNDKPSTWWTCFVKRQFMNKSLSGPGQRREPGQPPSPEPWAAFSSKMYTIFCLYS

SEQ ID NO: 793695 - protein, 172 aa, Homo sapiens
RIHTGEKPYACKECGKAFSQSSALIQHQRIHTGEKPYKCNECGKAFSWISRLNIHHRIHTGEKPYNCKECGKAFSSHSGVNTHRKIHTGEKPYKCNDCEKAFNQSSALIQHQRIHTGEKPYNCKVCGKAFRQSSSLMTHMRIHTGEKPYICKECGKAFSQSSSLTKHQRTHN

SEQ ID NO: 793696 - protein, 151 aa, Homo sapiens
GARRGSRRLDAGEKPYKCNECGKAFSWISRLNIHHRIHTGEKPYNCKECGKAFSSHSGVNTHRKIHTGEKPYKCNDCEKAFNQSSALIQHQRIHTGEKPYNCKVCGKAFRQSSSLMTHMRIHTGEKPYICKECGKAFSQSSSLTKHQRTHN

SEQ ID NO: 793697 - protein, 80 aa, Homo sapiens
TAHLTGGQEEVKSSRGESTTDLPESTMDLESPTDVYLENTQAFQNEANSPLAVMITAIHYFLRRFYAFEHAYHYTIGDLL

SEQ ID NO: 793698 - protein, 108 aa, Homo sapiens
LGISPSLYEAGLQSLLGPAPSPQSTPLCAGPLTSQPPPGTAPPRTSSQTASDSVLKTRGLVPSFEKVPLSGGQLPGFSGLLRPQDSGTAQPALVSSTLRGLSVHRCPH

SEQ ID NO: 793699 - protein, 163 aa, Homo sapiens
AAGEVEQYKLVESADTPKASKGSYMEVRTGDPPERRDCELGRPGPDSQSSVAEISTIAKEVDKVNQIINNCIDALKSESTSFQGVKSGPVSVAEPPLVLLSEPLAAKHGFLAPGYKDAFGHSLQRHHSVEAAGPPRASTSSSGSVRSPRAFRAEAVGVHKAAA

SEQ ID NO: 793700 - protein, 74 aa, Homo sapiens
GRVQECPGLSEDHVCNPRIPRAPHGEGDQKDPKQFSKKKEAIKSGSKGPLRTERPHGSTVAGGSFSMIENPASQ

SEQ ID NO: 793701 - protein, 214 aa, Homo sapiens
VLTILSTLRSRVSPQGAMEQGSGRLEDFPVNVFSVTPYTPSTADIQVSDDDKAGATLLFSGIFLGLVGITFTVMGWIKYQGVSHFEWTQLLGPVLLSVGVTFILIAVCKFKMLSCQLCKESEERVPDSEQTPGGPSFVFTGINQPITFHGATVVQYIPPPYGSPEPMGINTSYLQSVEQDRAELPCQHMGNDMIETIFMTKRNSSSSLKKLWCP

SEQ ID NO: 793702 - protein, 260 aa, Homo sapiens
VLTILSTLRSRVSPQGAMEQGSGRLEDFPVNVFSVTPYTPSTADIQVSDDDKAGATLLFSGIFLGLVGITFTVMGWIKYQGVSHFEWTQLLGPVLLSVGVTFILIAVCKFKMLSCQLCKESEERVPDSEQTPGGPSFVFTGINQPITFHGATVVQYIPPPYGSPEPMGINTSYLQSVVSPCGLITSGGAAAAMSSPPQYYTIYPQDNSAFVVDEGCLSFTDGGNHRPNPDVDQLEETQLEEEACACFSPPPYEEIYSLPR

SEQ ID NO: 793703 - protein, 260 aa, Homo sapiens; identical to SEQ ID NO: 793702

SEQ ID NO: 793704 - protein, 260 aa, Homo sapiens; identical to SEQ ID NO: 793702

SEQ ID NO: 793705 - protein, 80 aa, Homo sapiens
IRYKNKCGILDGILQQKKDNWIKTEDIMNKAWMLVNNDNMGQAWWLTPVILALWEAKVCGLLEVQEFKTSLANMVKPRLY

SEQ ID NO: 793706 - protein, 78 aa, Homo sapiens
TPLSLFHDRDSWEGPNLAGVGVFLDTAVFPGARSPRSLWTRGLSRESLINACSQSGARQEMHATVLRERFPKAVSGPP

SEQ ID NO: 793707 - protein, 140 aa, Homo sapiens
ASGYSNNIFTIDQMLKKKQTCTVADATAIKQHVKRATDTYNLGIALEHRKEMLNLWQKIRGDLIGMDSRNESFYDTFSTYTWSWNVCQELLSPKDLRLYDAYVNRNSSHNSRSSSSSDTSECYTDSGRKRKRKGLKGFQQ

SEQ ID NO: 793708 - protein, 85 aa, Homo sapiens
EGWKSAVGLRKRKQELVDSKRKLTSSRKEHGTKESAVARFNRVKTELPYKKRGPKGGHQLDEYVFESCSFIVEMWEDSSKYAPWH

SEQ ID NO: 793709 - protein, 183 aa, Homo sapiens
RGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSGQYGSLAWWEGPGFQVKAELDSRLHHLRIM

SEQ ID NO: 793710 - protein, 162 aa, Homo sapiens
RGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSGHLAAVCTL

SEQ ID NO: 793711 - protein, 121 aa, Homo sapiens
MSVRFNGSLRELAPRPKFGRAPTDQAALPAPTQVPGALCPQVPTPSAVPDVQAEVSPGHVIRGEPPGKTEHEVPSGPASYTPQAKQSPAHQCFWMQPHFTLAGEAAPGWQLAASSSSTLLN

SEQ ID NO: 793712 - protein, 100 aa, Homo sapiens
VTPPVAGGFPWRPQAVQALGRGDGSLWSTKARESSAPGCPRPVQVGKGLTSILGRQSQAEERDLQKRKKRWDSMKACFRWAGWWDDGGDNDSINHGSLHM

SEQ ID NO: 793713 - protein, 99 aa, Homo sapiens
CRDRVLQCTQAGRELLSSSNLPAWASQSARNTGVSHHTQPTIVTGSGAGIAMVSGNLIIHYAISPSLKEQLFYAILDFALSEAMGLFCLTVTFLILFAM

SEQ ID NO: 793714 - protein, 110 aa, Homo sapiens
FPVMPARGEGLSSPCCKVLCSLGLPGCTIMVISKYHISHILRKAHIVTRLFLTQRIIHCKKNKNQIKELRGGQMLSAQVLALFVPPVSDRQNTWSKKTLETVIYEDQGLL

SEQ ID NO: 793715 - protein, 345 aa, Homo sapiens
MLMFDPVPVKQEAMDPVSVSYPSNYMESMKPNKYGVIYSTPLPEKFFQTPEGLSHGIQMEPVDLTVNKRSSPPSAGNSPSSLKFPSSHRRASPGLSMPSSSPPIKKYSPPSPGVQPFGVPLSMPPVMAAALSRHGIRSPGILPVIQPVVVQPVPFMYTSHLQQPLMVSLSEEMENSSSSMQVPVIESYEKPISQKKIKIEPGIEPQRTDYYPEEMSPPLMNSVSPPQALLQENHPSVIVQPGKRPLPVESPDTQRKRRIHRCDYDGCNKVYTKSSHLKAHRRTHTGEKPYKCTWEGCTWKFARSDELTRHFRKHTGIKPFQCPDCDRSFSRSDHLALHRKRHMLV

SEQ ID NO: 793716 - protein, 345 aa, Homo sapiens; identical to SEQ ID NO: 793715

SEQ ID NO: 793717 - protein, 345 aa, Homo sapiens; identical to SEQ ID NO: 793715

SEQ ID NO: 793718 - protein, 345 aa, Homo sapiens; identical to SEQ ID NO: 793715

SEQ ID NO: 793719 - protein, 232 aa, Homo sapiens
MLMFDPVPVKQEAMDPVSVSYPSNYMESMKPNKYGVIYSTPLPEKFFQTPEGLSHGIQMEPVDLTVNKRSSPPSAGNSPSSLKFPSSHRRASPGLSMPSSSPPIKKYSPPSPGVQPFGVPLSMPPVMAAALSRHGIRSPGILPVIQPVVVQPVPFMYTSHLQQPLMVSLSEEMENSSSSMQVPVIESYEKPISQKKIKIEPGIEPQRTDYYPEEMSPPLMNSVSPPQALLQE

SEQ ID NO: 793720 - protein, 345 aa, Homo sapiens; identical to SEQ ID NO: 793715

SEQ ID NO: 793721 - protein, 345 aa, Homo sapiens; identical to SEQ ID NO: 793715

SEQ ID NO: 793722 - protein, 345 aa, Homo sapiens; identical to SEQ ID NO: 793715

SEQ ID NO: 793723 - protein, 345 aa, Homo sapiens; identical to SEQ ID NO: 793715

SEQ ID NO: 793724 - protein, 101 aa, Homo sapiens
RLAERAAPASCDCPELVPGARGEPGAEPRGAGARAGAQRERPPHARPSPSPAAANAARTGALTLLRSGGSRQPVSGPLFLVGGALHRASQSQTPEHPRRFN

SEQ ID NO: 793725 - protein, 119 aa, Homo sapiens
SQPLCLTIPLSVPSPTQPPTLLLSLIFSFPYEAILMKSGTGRSLGTDKCQLSLAVSLPHGCSREGGQRAEVTVAKPETEAQLWLGKKQGNKITWGQRAWGHQSGQRLPRSCKSEPLPAL

SEQ ID NO: 793726 - protein, 154 aa, Homo sapiens
SCPRVMGSARFIPTKPRTVAIKPSAFSRRNPGREKDGSASLEGARRQRRVGSRQRTPGPDGQDASPRAREEDGGRERRGGLSHSKDCNAARNARGKHLRRTRRRRTLGSHWKIQPGVQRLPRPTPSVQPRHAPVAPPCSHTPPRRAPRPARAPP

SEQ ID NO: 793727 - protein, 194 aa, Homo sapiens
ASLKDEVLKIMPVQKQTRAGQRTRFKAFVAIGDYNGHVGLGVKCSKEVATAICGAIILAKLSIVPVHRGYWGNKIGKPHTVPCKVTGRCGSVLVHLIPAPRGTGIVSAPVPKKLLMMAGIDDCYTPAQGCTATLGNFAKATFDAISKTYSYLTPDLWKETVFTKSPYQDFTDHLVKTHTRVSMQRTQAPAVATT

SEQ ID NO: 793728 - protein, 194 aa, Homo sapiens; identical to SEQ ID NO: 793727

SEQ ID NO: 793729 - protein, 71 aa, Homo sapiens
EAAIKVSSRDGVSSEGSTETARPTLPLRRRMKEAEEKEDFYDDPLPPNQYCSKAFIIHSYYFTFIFLKKGL

SEQ ID NO: 793730 - protein, 92 aa, Homo sapiens
QVPLSTQSSGAGPHGENRLVSGRNSQKLELQTEVRDSGQRKAHWTELTSVLSGVSPRSFFLEAHHPYSLWGENSFAKPAQMSQQARPPERWM

SEQ ID NO: 793731 - protein, 420 aa, Homo sapiens
MSPKDKLCVIHHPARAPKQYLCRPPKGPPNGKVLVASPKQAPRLGLGPSGSSCSQGTRLPPTGFQMAPCGCFFDPRIYRIEWTTPDLGQSALYKLAASSGGPAGVPSAPGSYLLEPQPYLKAPGLPPYPHYQQAPGGPQFLLPYFPPEGPGPEALGFVGDAGPAAFVELPLPPLEEGPAPLPPPPPKENKPPPVLITLPAEPTLPPDAYSHLQGHLGHFPGPEPLAFPVKELQGSGARPGVPLYPPGLSELKVAEVKEGALLGAGKAKAPKTARALALPDKVLLEDAMKLFDCLPGASEPEGTLCEVPGPALPDSSGGNSADDIRSLCLPEELLSFDYSVPEILDTVSNVDYFFNFKALDEEQPPHPGPPATNDPGPHSVWQEKGLDGQEGKAGKEGQAAGRPSQRHSPGAQGGPGSHPD

SEQ ID NO: 793732 - protein, 420 aa, Homo sapiens
MSPKDKLCVIHHPARAPKQYLCRPPKGPPNGKVLVASPKQAPRLGLGPSGSSCSQGTRLPPTGFQMAPCGCFFDPRIYRIEWTTPDLGQSALYKLAASSGGPAGVPSAPGSYLLEPQPYLKAPGLPPYPHYQQAPGGPQFLLPYFPPEGPGPEALGFVGDAGPAAFVELPLPPLEEGPAPLPPPPPKENKPPPVLITLPAEPTLPPDAYSHLQGHLGHFPGPEPLAFPVKELQGSGARPGVPLYPPGLSELKVAEVKEGALLGAGKAKAPKTARALALPDKVLLEDAMKLFDCLPGASEPEGTLCEVPGPALPDSSGGNSADDIRSLCLPEELLSFDYSVPEILDTVSNVDYFFNFKALDEEQPPHPGPPATNTPAPILSGKRKASTAKKGKPGRKARQPAGPASATPPGPREDLGATPH

SEQ ID NO: 793733 - protein, 121 aa, Homo sapiens
EQVQELGQVSHEETWSIWRRFLKTFRREGEFSAEKLNLPYSSGPIWDLSLLTAPEGTAVIFCTACTPRNTLLNQRMSARLSSADRAGSTRAVGFHPSPPPPHAHSHGPSRLRGTLIKCGKQ

SEQ ID NO: 793734 - protein, 112 aa, Homo sapiens
KKEKRNSKYFFLTFLEAEKSRIQVRHGWVLGRSCFWAADRRLLTVSVVERVGEGESFLWGLFDEGTKPIHEGSTHLPSLWALGFQHMNFGGGHVQTIALPFPNYDNKISSNI

SEQ ID NO: 793735 - protein, 106 aa, Homo sapiens
SKKKKKKEKPPFPFPARCHLSIDSRSQKQPSQGEATRDLRVANVRKPSRDRVAKWLARPRTRTVPAQVPTLNTELRTLLVTGLAEWLLDPFSCCRSRKSQLSDTPW

SEQ ID NO: 793736 - protein, 68 aa, Homo sapiens
GRAVPGLHPGCVSPPRGAPESVKKTPEGKEQEGQPLKGKMRQSGKKLPTENSACPADPGPGFGKSWSP

SEQ ID NO: 793737 - protein, 71 aa, Homo sapiens
PACSLGVPSAVHAEMSFNLTAPCKPSRSPAVRRQATVPPTCVSCDNKAEEEREGLSLSRGGGGLRHNSAQS

SEQ ID NO: 793738 - protein, 114 aa, Homo sapiens
GVVHKPQCLHFWFLAFLKSPEPLLSGFIFPSASPGLPCTLNFTIILSFQLWAFATMVPSTWNALALLVLKSNTSSKGSGPPPPLLPLGQLCLPSMVFRDYLCHFLHFSTHVAWH

SEQ ID NO: 793739 - protein, 188 aa, Homo sapiens
FVDPTIKVDSGYRVHEDLRNLGLYVKTREGIPVMRPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFLWPYYQGIHHRNS

SEQ ID NO: 793740 - protein, 206 aa, Homo sapiens
CCVTASSGNATCNWRESMAVTSQHNDIIEMLVQDIFVPSGNLYIMPWKGFCHEPLWVQYPQDVTTFNIDDQYLLGDALLVHPVSDSGAHGVQVYLPGQGEVWYDIQSYQKHHGPQTLYLPVTLSSIPVFQRGGTIVPRWMRVRRSSECMKDDPITLFVALSPQGTAQGELFLDDGHTFNYQTRQEFLLRRFSFLWPYYQGIHHRNS

SEQ ID NO: 793741 - protein, 103 aa, Homo sapiens
PYPVPPCYVEVTQQTDTQSPSGDHLPCLPTSRATVGSTAIPSVTGPWEPQGCPARLVCSGYILAKLPLPADLHVYCCHLQLSAPRPPWAVRKGPGGEVGRKDS

SEQ ID NO: 793742 - protein, 91 aa, Homo sapiens
MLCQRGKSAGTIQGLSHMTQPGKPIPTAQEGVMVAHQVLSEGVQGPKALIKDTPRPKDNPCEAVEPQDHDQQGQGSGWTEVGGSCTAGFQL

SEQ ID NO: 793743 - protein, 112 aa, Homo sapiens
FFLGVDAGWAEGRGLGQDRALKNDSDPGLSSGRDGGGGRGGTAAPEAGARRWLCACAAAHGQDARGVVAAGLQEALQPTLEARGPLVPNSARESKNYDGNMNILKAPCMIHM

SEQ ID NO: 793744 - protein, 126 aa, Homo sapiens
MKGQLPPQAMVAETKAMGRCRRLRNQQEVPAGNTERIWRKLLFCPYSFGDPDGISGTPCLLYNWDPWKSDRIWQQMSKKGHFLADLRYIGDIKKRIIHQSLQILQAKLKQARQVLFVFLRDLESLT

SEQ ID NO: 793745 - protein, 615 aa, Homo sapiens
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 793746 - protein, 517 aa, Homo sapiens
TRAGTQGKASHGCLRRDAAPGEAVRRELGGAGGPGRPLSELAGSQVAGCPLPQVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 793747 - protein, 252 aa, Homo sapiens
EPTLNQTPAVPEPEQLIWGKLGAGRRMDEIWYPLIKGDLGYGVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 793748 - protein, 179 aa, Homo sapiens
MPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 793749 - protein, 89 aa, Homo sapiens
LTHSSANQPRVGIALPLTKLTPGQASPWSPTHTPVSLRSLTPYLPPSGLQISHFKIPKYIVFVTNYPLTISGKIQKFKLREQMERHLNL

SEQ ID NO: 793750 - protein, 295 aa, Homo sapiens
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSVGQRSPGPKPRWTHAPCPCDTSAGMGRQQRR

SEQ ID NO: 793751 - protein, 155 aa, Homo sapiens
QVLGSLEGACAQLTDLVVVELQDEEVDQRGEQPPGQLSDLVVVQVEVGQLGQVVEGTCAQHADVVMGQVQVDKLLEAAEGTGGHLADLAVLQVNDTRFGMARNELAASTGKLLRCRLSSLVFSDTLGIFCSPTLSQMTCCRSLWQWQFWGQAASA

SEQ ID NO: 793752 - protein, 86 aa, Homo sapiens
SMGRWTAKHRCPARTSWQVAYGTTENSPVTFAHFPEDTVEQKTEEAVDQDKWYWTGTVLAARGPEESKMRRILLFGGRQMMPNIDK

SEQ ID NO: 793753 - protein, 179 aa, Homo sapiens; identical to SEQ ID NO: 793748

SEQ ID NO: 793754 - protein, 119 aa, Homo sapiens [sequence omitted]

SEQ ID NO: 793755 - protein, 90 aa, Homo sapiens
LAGCAMPLVPGRLIWDSQTHSSSPYSSREVDRMVSTPIGGLSYVQGCTKKHLNSKTVGQCLETTAQRVPEREALVVLHEDVRLTFAQLKE

SEQ ID NO: 793756 - protein, 673 aa, Homo sapiens
MASQFCLPESPCLSPLKPLKPHFGDIQEGIYVAIQRSDKRIHLAVVTEINRENYWVTVEWVEKAVKKGKKIDLETILLLNPALDSAEHPMPPPPLSPLALAPSSAIRDQRTVTKWVAMIPQKNQTASGDSLDVRVPSKPCLMKQKKSPCLWEIQKLQEQREKRRRLQQEIRARRALDVNTRNPNYEIMHMIEEYRRHLDSSKISVLEPPQEHRICVCVRKRPLNQRETTLKDLDIITVPSDNVVMVHESKQKVDLTRYLQNQTFCFDHAFDDKASNELVYQFTAQPLVESIFRKGMATCFAYGQTRSGKTYTVGGDFSGTAQDCSKGIYALVAQDVFLLLRNSTYEKLDLKVYGTFFEIYGGKVYDLLNWKKKLQVLEDGNQQIQVVGLQEKEVCCVEEVLNLVEIGNSCRTSRQTSVNAHSSRSHAVFQIILKSGGIMHGKFSLVDLAGNERGADTTKASRKRQLEGAEINKSLLALKECILALGQNKPHTPFRASKLTLVLRDSFIGQNSSTCMIATISPGMTSCENTLNTLRYANRVKKLNVDVRPYHRGHYPIGHEAPRMLKSHIGNSEMSLQRDEFIKIPYVQSEEQKEIEEVETLPTLLGKDTTISGKGSSQWLENIQERAGGVHHDIDFCIARSLSILEQKIDALTEIQKKLKLLLADLHVKSKVE

SEQ ID NO: 793757 - protein, 105 aa, Homo sapiens
HHCFHSHHPHHLPRPFHLHLARSHQPKDRCGLIEDHGGPRSSPYTNPLFLIWEHLRTCPMHGTVLSAKGTDQPFLEEMEKKHFLPAPTPASKFQTCKACFIPWAA

SEQ ID NO: 793758 - protein, 403 aa, Homo sapiens
MASKKFAVKCGNFAVLVDLHILPQGSNKDTSWFSEQKKEEVCLLLKETIDSRVQEYLEVRKQHRPSNAEFTRSNPLSLKGYGFQITAYFLKRGIRLRCIRSTQNAELCVFPDRFVVCVSQLAFSRDLLASQNEDLTERVLHGVSDYFAECAESSLPPSAKLRRNALKEIVKRTETKSSVTSKSQTRRDTVETSSDSVIAEIARRRNDGQASSSPPSESMGQAKDSIKAAESHWGLPVQKLEKVNQTQPEDTSGQQKPHPGERLKTGLLSRSPVCSCESASPCPKQSPRVAKTQQKRRNCSSAEDFDHHGRVSLGSDRLVPREIIVEKSKAVRVLPASELSDPGLLLKQDLAKTTSKEELHVLESLSSRHLMKNNPGQAQQTGLATNTERLSTIQNSPTKKRKK

SEQ ID NO: 793759 - protein, 150 aa, Homo sapiens [sequence omitted]

SEQ ID NO: 793760 - protein, 218 aa, Homo sapiens
MASKKFAVKCGNFAVLVDLHILPQGSNKDTSWFSEQKKEEVCLLLKETIDSRVQEYLEVRKQHRPSNAEFTRSNPLSLKGYGFQITAYFLKRGIRLRCIRSTQNAELCVFPDRFVVCVSQLAFSRDLLASQNEDLDNQSTIACFLLPEGRGNPPFTIKVLALSHIQRRLIYALPIPGVSQTEASGSYPRNSGVLQNPSLQTTRTRFCFRIVFDSTAAK

SEQ ID NO: 793761 - protein, 194 aa, Homo sapiens
MASKKFAVKCGNFAVLVDLHILPQGSNKDTSWFSEQKKEEVCLLLKETIDSRVQEYLEVRKQHRPSNAEFTRSNPLSLKGYGFQITAYFLKRGIRLRCIRSTQNAELCVFPDRFVVCVSQLAFSRDLLASQNEDLDNQSTIACFLLPEGRGDLCPPNTRGVPDRSIWQLPKEFWGPAESKFTNHQNKVLLQDSV

SEQ ID NO: 793762 - protein, 189 aa, Homo sapiens
VGQAGLELPTSGDPPASASQIAGITGVRQLARQPSAASHMSLAPWPSLTRHLGGPSCQYASPTAEPKAVSSPAPCLGSPGAPFPRLKPGQPQATSLPDHSTTWPHATLLSTADTAWPQRLKPLPWVLLSAEPRAQSQGLGESPVHGQWDSPDENPSHVRLASPGSLRPVSPGLAGGKAPGPLKPLIMFP

SEQ ID NO: 793763 - protein, 107 aa, Homo sapiens
VGQAGLELPTSGDPPASASQIAGITGVRQLARQPSAASHMSLAPWPSLTRHLGGPSCQYASPTAEPKAVSSPAPCLGSPGAPFPRLKPGQPQATSLPPRPNPGHGLG

SEQ ID NO: 793764 - protein, 150 aa, Homo sapiens
CVQMRKAGRVTWFGKKKVTFKVIGHVMIRDACEPHEAIKCAVRYMNLKTDSPDYKWCISFTYAVTNYHKIRVFKTTTNWPGAVVHACNPSTLEGRGGRNHKGEEIETILGNRVTLRLKKKEKYCEAKQIIHGLSIYIYFTKNSKCSIWQY

SEQ ID NO: 793765 - protein, 116 aa, Homo sapiens
LVRELEKKFGEKHVVFIAQRRILPKPTRKSCTKNKQKHPRSRTLKAMHDSIPEDLVFPSEIVGKRIHVKLDGSRLIKAHLDKAQQNNVERNVETFSGVYMKLTGKDINVEFPEFQL

SEQ ID NO: 793766 - protein, 130 aa, Homo sapiens [sequence omitted]

SEQ ID NO: 793767 - protein, 178 aa, Homo sapiens
GISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQ

SEQ ID NO: 793768 - protein, 122 aa, Homo sapiens
GISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGAENNTSAKCRSSFMTVNDS

SEQ ID NO: 793769 - protein, 629 aa, Homo sapiens
KALCKCSLPSRLLPLGENLPLLDRGFRKEPRSRGSRERDNMLHLHHSCLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGSEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 793770 - protein, 416 aa, Homo sapiens
KALCKCSLPSRLLPLGENLPLLDRGFRKEPRSRGSRERDNMLHLHHSWTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGARCPRTE

SEQ ID NO: 793771 - protein, 455 aa, Homo sapiens
MRPVINRCAPGSLDLMLPQAASEGIVFHSLQISLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGARCPRTE

SEQ ID NO: 793772 - protein, 575 aa, Homo sapiens
KALCKCSLPSRLLPLGENLPLLDRGFRKEPRSRGSRERDNMLHLHHSWTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGSEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 793773 - protein, 340 aa, Homo sapiens
KALCKCSLPSRLLPLGENLPLLDRGFRKEPRSRGSRERDNMLHLHHSWTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLALLCSHNKSWVM

SEQ ID NO: 793774 - protein, 131 aa, Homo sapiens
VSISSSYLTQPLPHLLKRNLKCRDGQCLAGGTMGWGSVVGQKPGRWSLQLGTIPLCADDLGTEAGLNCRRGGVRLRGGVGLGLLNTRAKGWNTRNWEWRWGIPERMTSESQPQPALLSMLPVRAGDLPECL

SEQ ID NO: 793775 - protein, 123 aa, Homo sapiens
MGGLRSVKHIYLALRKMQLNVGFLSSVPLSIAAPKGKLFPLYSPTTLNSSNNRCGLFSPPSQPRPLTNEWSALNFSLSLLFMSRYSHSSYTFSHGHYNLCAVREVINIVLSYPSCQRPSLVPS

SEQ ID NO: 793776 - protein, 127 aa, Homo sapiens
LGASVLLRALATNPNLTALDISGNAMGDAGAKLLAKALRVNSRLRSVVWDRNHTSALGLLDVAQALEQNHSLKAMPLPLNDVAQAQRSRPELTARAVHQIQACLLRNNRADPASSDHTTRLQPLGLV

SEQ ID NO: 793777 - protein, 60 aa, Homo sapiens
KRGFAFVTFDEHDTVDKIVVQKYHTINGHNCEVKKALSKQEMQSAGSQRGRGGGSGNFMG

SEQ ID NO: 793778 - protein, 111 aa, Homo sapiens
KLREDAKIPACEESLSQTPPRVTGTSPAQDQDHPSEEQGGQGSCREPGVNPCLSRLGRLQQKMLLACRAPSLRTRVQKEGLSPRRAQKTRSLKLYLETLKVPSLAELHSRL

SEQ ID NO: 793779 - protein, 281 aa, Homo sapiens
ENAGPASGRRSARLPCSAGKMGKVRGLRARVHQAAVRPKGEAAPGPAPPAPEATPPPASAAGKDWAFINTNIFARTKIDPSALVQKLELDVRSVTSVRRGEAGSSARSVPSIRRGAEAKTVLPKKEKMKLRREQWLQKIEAIKLAEQKHREERRRRATVVVGDLHPLRDALPELLGLEAGSRRQARSEEGKDPVSGAAGQSGLQKPDPCVAIGQTLAGRCSWKWRQALSRAAGHATTPQDTCGPSRERRPLKDHGLSLVDALPSGRLWGSINGSVNFPCKK

SEQ ID NO: 793780 - protein, 224 aa, Homo sapiens
ENAGPASGRRSARLPCSAGKMGKVRGLRARVHQAAVRPKGEAAPGPAPPAPEATPPPASAAGKDWAFINTNIFARTKIDPSALVQKLELDVRSVTSVRRGAEAKTVLPKKEKMKLRREQWLQKIEAIKLAEQKHREERRRRATVVVGDLHPLRDALPELLGLEAGSRRQARRKQGLCAVVQTWGPSFHGPAAQARGWQVTRCRPRQLQAGIPRRRHQSTGSRIG

SEQ ID NO: 793781 - protein, 188 aa, Homo sapiens
ENAGPASGRRSARLPCSAGKMGKVRGLRARVHQAAVRPKGEAAPGPAPPAPEATPPPASAAGKDWAFINTNIFARTKIDPSALVQKLELDVRSVTSVRRGAEAKTVLPKKEKMKLRREQWLQKIEAIKLAEQKHREERRRRATTPQDTCGPSRERRPLKDHGLSLVDALPSGRLWGSINGSVNFPCKK

SEQ ID NO: 793782 - protein, 305 aa, Homo sapiens
ENAGPASGRRSARLPCSAGKMGKVRGLRARVHQAAVRPKGEAAPGPAPPAPEATPPPASAAGKDWAFINTNIFARTKIDPSALVQKLELDVRSVTSVRRGEAGSSARSVPSIRRGAEAKTVLPKKEKMKLRREQWLQKIEAIKLAEQKHREERRRRATVVVGDLHPLRDALPELLGLEAGSRRQARSRESNKPRPSELSRDERRPKRQQLLEEGKDPVSGAAGQSGLQKPDPCVAIGQTLAGRCSWKWRQALSRAAGHATTPQDTCGPSRERRPLKDHGLSLVDALPSGRLWGSINGSVNFPCKK

SEQ ID NO: 793783 - protein, 132 aa, Homo sapiens
PLPPCVARQPWPGNQVLRYLLSLRCLSAVHRAPDGVAHVRNERSHNRQDLRECVGAGGHVCQHKLLETVPYRRQTAKHGGLRIMCYLPIHGAPASVPESTTPAPLSDIVHVIVLFSLEVYIHFRPQASWGQE

SEQ ID NO: 793784 - protein, 32 aa, Homo sapiens
LSLCAEPLGAAGGLTQHPYGYHHLDCTGSDLK

SEQ ID NO: 793785 - protein, 77 aa, Homo sapiens
PQSVSGLDPRPFPPGRFRSNLLSERAAVSGAHIRRCPVEWGKEFLCSEEGLAMVLDPILVSDLPPRNIGGLYALASL

SEQ ID NO: 793786 - protein, 92 aa, Homo sapiens
GKIEGLSSKVWNKTKMPTFTAFISSTLLSLGGLPPLTGFLPKWAIIEEFTKNNSLIIPTIIATITLLNLYFYLRLIYSTSFTQKENQLRRCH

SEQ ID NO: 793787 - protein, 132 aa, Homo sapiens
MFGESTGQRLAQVPSWESPTGVYCPNFGACTEHPPLVGETSPLGHRTCRGRHEKGVDWGMVVLVTPPCSVPCPPPRLPAPSQPVSFPGAQESMSSTQALCDNSTPGPVFPSSPTLCDVESHFTDGETEESSK

SEQ ID NO: 793788 - protein, 391 aa, Homo sapiens
MGPEASFFDVLDRHRESLLAALRRGGREPPTGGSRLASSSEVLASIENIIQDIITSLARNEAPAFTIDNRSSWENIKFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNLVTDAKFVLIVEKDATFQRLLDDNFCNKLSPCIMITGKGVPDLNTRLLVKKLWDTFHVPVFTLVDADPHGIEIMCIYKYGSMSMSFEAHHLTVPAIRWLGLLPSDLKRLNVPKDSLIPLTKRDQMKLDSILRRPYVTCQPFWRKEMEIMADSKMKAEIQALTFLSSDYLSRVYLPNKLKFGGWI

SEQ ID NO: 793789 - protein, 353 aa, Homo sapiens
MGPEASFFDVLDRHRESLLAALRRGGREPPTGGSRLASRFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNLVTDAKFVLIVEKDATFQRLLDDNFCNKLSPCIMITGKGVPDLNTRLLVKKLWDTFHVPVFTLVDADPHGIEIMCIYKYGSMSMSFEAHHLTVPAIRWLGLLPSDLKRLNVPKDSLIPLTKRDQMKLDSILRRPYVTCQPFWRKEMEIMADSKMKAEIQALTFLSSDYLSRVYLPNKLKFGGWI

SEQ ID NO: 793790 - protein, 288 aa, Homo sapiens
MGPEASFFDVLDRHRESLLAALRRGGREPPTGGSRLASSSEVLASIENIIQDIITSLARNEAPAFTIDNRSSWENIKFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLRYIEEDGTKVNCTCGATAVAVPSNIQGIRNLVTDAKFVLIVEKDATFQRLLDDNFCNKLSPCIMITSTPVFQHLKSKGKGVPDLNTRLLVKKLWDTFHVPVFTLVDADPHD

SEQ ID NO: 793791 - protein, 178 aa, Homo sapiens
MGPEASFFDVLDRHRESLLAALRRGGREPPTGGSRLASSSEVLASIENIIQDIITSLARNEAPAFTIDNRSSWENIKFEDSVGLQMVSHCTTRKIKSDSPKSAQKFSLILKILSMIYKLVQSNTYATKRDIYYTDSQLFGNQTVVDNIINDISCMLKVSRRSLHILSTSKGLIAGNLR

SEQ ID NO: 793792 - protein, 77 aa, Homo sapiens
RRHGDRSKRLESLMEGATSREVQAASRNWKGMQPDVPPAIPKPPEGMQLYWHLNFSSIKSSFWTCALYNIHQNGTHS

SEQ ID NO: 793793 - protein, 86 aa, Homo sapiens
RRHGDRSKRLESLMEGATSREVQAASRNWKGMQPDVPPAIPKPPEGMQLYWHLNFSSIKSSFWTCALYNSKRLDFYYFKPLLVVIG

SEQ ID NO: 793794 - protein, 78 aa, Homo sapiens
HCFSTRKLIFVINHFYNERAAWTHCHTFPILQLFLGDGEVISAWAGTEICLRVLVILEVLDFHLVMKYCHGQRGLLKG

SEQ ID NO: 793795 - protein, 114 aa, Homo sapiens
MKWKPPLVWQIINSVSTFAGFGTFVFFRGSGLTPAIAVASGEPLPSGGSRREPPSPPSSQQGFPKRPGQEGWALLSTKSLRRSQSHMIGLIGSAPVKGRLKTRHPNSLNQEEKS

SEQ ID NO: 793796 - protein, 119 aa, Homo sapiens
VKEEGGVAVSVGTGLLSVSVFICLGYCNTAPQTVTQHPWVCRQGFTVPQLWRLEAKIKMCARLFPAESCEGSFCSGPLSPACLWPSSHSLFASSSLYAIECKMSYQERNITANYVVPSN

SEQ ID NO: 793797 - protein, 95 aa, Homo sapiens
FCPLPRGQGCPESASEISLGFTVPQLWRLEAKIKMCARLFPAESCEGSFCSGPLSPACLWPSSHSLFASSSLYAIECKMSYQERNITANYVVPSN

SEQ ID NO: 793798 - protein, 191 aa, Homo sapiens
LSARGPGISDEALDPRAAKLRRGAPWRPRDPWPVRAGAAGSQGAAGSSAGMALSAEDRALVRALWKKLGSNVGVYTTEALERTFLAFPATKTYFSHLDLSPGSSQVRAHGQKVADALSLAVERLDDLPHALSALSHLHACQLRVDPASFQPGHCLLVTLARHYPGDFSPALQASLDKFLSHVISALVSEYR

SEQ ID NO: 793799 - protein, 177 aa, Homo sapiens
LSARGPGISDEALDPRAAKLRRGAPWRPRDPWPVRAGAAGSQGAAGSSAGMALSAEDRALVRALWKKLGSNVGVYTTEALERTFLAFPATKTYFSHLDLSPGSSQVRAHGQKVADALSLAVERLDDLPHALSALSHPGHCLLVTLARHYPGDFSPALQASLDKFLSHVISALVSEYR

SEQ ID NO: 793800 - protein, 106 aa, Homo sapiens
GFKRFLCLSLLSSWNYRRLPPCPTNFCIFSRDGVSPCWPGWSQTPELRISTCLSLGITGVSYRAQQQSSRIHSHGFNHLHEYLCPRFPKLYNCISKCYLYIYTSPI

SEQ ID NO: 793801 - protein, 123 aa, Homo sapiens
MKTWKTQKGSDFPKVTKLKAMRPGDTLVASHHSVKKTGVYSVNQCNKNEKYAFSNPFLKELAPGYGNSTALIHLLLVTQKLAIRYLEIMPKAFIVTERTTLPLLLVNNHSVQELCIQESVFLL

SEQ ID NO: 793802 - protein, 211 aa, Homo sapiens
MAPLAEVGGFLGGLEGLGQQVGSHFLLPPAGERPPLLGERRSAAERSARGGPGAAQLAHLHGILRRRQLYCRTGFHLQILPDGSVQGTRQDHSLFGILEFISVAVGLVSIRGVDSGLYLGMNDKGELYGSEKLTSECIFREQFEENWYNTYSSNIYKHGDTGRRYFVALNKDGTPRDGARSKRHQKFTHFLPRPVDPERVPELYKDLLMYT

SEQ ID NO: 793803 - protein, 171 aa, Homo sapiens
LLASSSPGLTLRLLSRLSPTCFPASQTPVSLHSQLFSLHVSPPLSPTPRTPIPRLLSPALLLPLSSLQLFIRFHLRLCAHPIQSPAPVRLLEAMAGPGGWRDREVTDLGHLPDPTGIFSLDKTIGHGTYGRIYLGLHEKTGAFTAVKVMNARKTPLPEIGRRVRVNKYQKS

SEQ ID NO: 793804 - protein, 76 aa, Homo sapiens
SCAVCHKAPGAAKVAHVLPGLEGGPGEGELLLWTVDFDITHRHPLSHPCIPDSVPQGHAGRDTQPPCALPQVPVCK

SEQ ID NO: 793805 - protein, 105 aa, Homo sapiens
FLHPLTHVPVNKGTLGIHQVKLVVQASPGLSNGCGVAQHAHSSLYLGKVFPSKNCGKVVLDANCKATGALMHILIAAIGVCNWVSTGSINHRLGNNVPTGACKAG

SEQ ID NO: 793806 - protein, 111 aa, Homo sapiens
MELCSWSGWGPPAQPALTPQHTCSSTFQPAGFCARSSLCCGCSGLLNFTPNHPLPCFPREVTPLPPFAQVKATYRPRFRPLPPPYSMSCQLTPQSSALPLHGHHLRHHHLL

SEQ ID NO: 793807 - protein, 209 aa, Homo sapiens
WAAHRDLILDLDKMEIISSKLFILLTLATSSLLTSNIFCADELVMSNLHSKENYDKYSEPRGYPKGERSLNFEELKDWGPKNVIKMSTPAVNKMPHSFANLPLRFGRNVQEERSAGATANLPLRSGRNMEVSLVRRVPNLPQRFGRTTTAKSVCRMLSDLCQGSMHSPCANDLFYSMTCQHQEIQNPDQKQSRRLLFKKIDDAELKQEK

SEQ ID NO: 793808 - protein, 207 aa, Homo sapiens
PAPGALGTDSLKNLTLRDLSLRGNSETSSDTPEMSLSAETLSPSTPSDVNFLLPPEDAGEEAEAKNELSPMDRGLGVRAAFPEVSTPDGSSQGATQMPLYSSPIVKNPFMSPLLAPDSMLKSLPPVHIVACALDPMLDDSVMLARRLRNLGQPVTLRVVEDLPHGFLTLEALCRRDAPGRRAVRGAIRLVLTPPPEPGRAGRRGLRG

SEQ ID NO: 793809 - protein, 174 aa, Homo sapiens
MTHCCSPCCQPTCCRTTCCRTTCWKPTTVTTCSSTPCCQPACCVSSCCQPCCRPTCCQNTCCRTTCCQPTCVTSCCQPSCCSTPCCQPTCCGSSCCGQTSCGSSCGQSSSCAPVYCRRTCYYPTTVCLPGCLNQSCGSNCCQPCCRPACCETTCCRTTCFQPTCVSSCCQPSCC

SEQ ID NO: 793810 - protein, 154 aa, Homo sapiens
MTHCCSPCCQPTCCRTTCCRTTCWKPTTVTTCSSTPCCQPACCVSSCCQPCCRPTCCQNTCCRTTCCQPTCVTSCCGQTSCGSSCGQSSSCAPVYCRRTCYYPTTVCLPGCLNQSCGSSCCQPCCRPACCETTCCRTTCFQPTCVSSCCQPSCC

SEQ ID NO: 793811 - protein, 89 aa, Homo sapiens
EELAVARPEDTVGALKSKYFPGQESQMKLIYQGRLLQDPARTLRSLNITDNCVIHCHRSPPGSAVPGPSASLAPSATEPPSLGVNVGRP

SEQ ID NO: 793812 - protein, 323 aa, Homo sapiens
VLLRRLGPGSPSVRVGPWTPVQRRGNRTIQKRNLRLRKRVRDPSSPCGHGTRVDHRLDRAKTPEAGHLGSCRAPPHESSLCLQSFSSFFAAVSFPVNHGYDINLLTIRGSVVVVINNYYRYKQLQFAVCQALCQVFCFDDFTSSSKQPHVGLGQLEPKQTRDLVATPQALLMLSPFVPAAWTLPAARPWSSLMSPSLRVWVMSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 793813 - protein, 101 aa, Homo sapiens
PLEPPTSPAQLSQPQRPRSGSQKQTMPQMNMGTVSCEALGCRPPPTPGALTTPSPSSDHLAQRAEGGPISTPSTCRYPQRSSQRGCPHPAPPSSRLLCPSS

SEQ ID NO: 793814 - protein, 75 aa, Homo sapiens
TIPTAQGGDHIARNCGQPLEAESRIQPMARSQAPQSCSHKEMNPASNPRRLRNGSFPSRASDETIVLVDTKTVTL

SEQ ID NO: 793815 - protein, 282 aa, Homo sapiens
CKRKRRETHTHCLKQPIKKKKSGRGSWVKSQLPSQACWPPLVLRANVRAGWRCRTPRQLLSPEGRLLPTVTPQDSEARRNRALRRAAEERHQAGRREVEALRLWTQLQELRREHARLQRRLKRLEPCARLLEQALELLPGFQEVPELVARFDGLAETQAALRLREREQLAELEAARARLQQLRDAWPDEVLAQGQRRAQLQERLEAARERTLQWESKWIQIQNTAAEKTLLLGRSRMAVLNLFQLVCQHQGQPPTLDIEDTEGQLEHDQTISFQNQLSALRG

SEQ ID NO: 793816 - protein, 299 aa, Homo sapiens
CKRKRRETHTHCLKQPIKKKKSGRGSWVKSQLPSQACWPPLVLRANVRAGWRCRTPRQLLSPEGRLLPTVTPQDSEARRNRALRRAAEERHQAGRREVEALRLWTQLQELRREHARLQRRLKRLEPCARLLEQALELLPGFQEVPELVARFDGLAETQAALRLREREQLAELEAARARLQQLRDAWPDEVLAQGQRRAQLQERLEAARERTLQWESKWIQIQNTAAEKTLLLGRSRMAVLNLFQLVCQHQGQPPTLDIEDTEGQLEHVRTPLYGTSSPQTLPLWKNEPKTPQLVTPSLG

SEQ ID NO: 793817 - protein, 166 aa, Homo sapiens
PRPSRRPLAHPLPCESVSPCAWPACFGPSGLPQRWPKGRLPSAEQVTNHFGGHGIDTAALEIRDKGPERGESRLRSESGSRENPPSPLPAALESQKPNSAQLSVWRARPGLQAQIHVPTPEHTQTPPESETASGRLRSSGLRGGTGAGAASRGNRTVVTGNVPRTE

SEQ ID NO: 793818 - protein, 187 aa, Homo sapiens
MEQSVYGQCKSCCSNLTAVLCLAETWDTEKQQIQIMDEIYKITSTERVQLLEKKLAVQLTELKSEIEEQGALQGTANRVYSSIQMPKDIYYFRRERELALKKTLQVAESKPLVVQADAVQRELESCLRREYTPENLPLLLLQYYTERIAQLAQSKYLHMLRWKRFCQHSKIMEQLYPLYKKQVGYIM

SEQ ID NO: 793819 - protein, 189 aa, Homo sapiens
PPNSSSSDVRTVSYTNLKFMATQIASGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGRQTYLPQPAICPALCVEADAQLLQKRYEEPSLIQESTFCSSTATSVPLCG

SEQ ID NO: 793820 - protein, 326 aa, Homo sapiens
LREGEGAGRSSAPQYVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRSGYLSGTLQPEQWEGSEYDAKSDMYSLGVVLLELFQPLEQKWSEQKF

SEQ ID NO: 793821 - protein, 241 aa, Homo sapiens
QVLKNPYNSQPSLCSCKPTLLVSLLESLSHVHEPNPLRSRQVYKLLCQTFIKMGLLSSFTSTEESSEENVNFLGQTEAQYHLMLHIQMQLCELSLWDWIVERNKRGREYVDESACPYVMANVATKIFQELVEGVFYIHNMGIVHRDLKPRNIFLHGPDQQVKIGDFGLACTDILQKNTDWTNRNGKRTPTHTSRSGYLSGTLQPEQWEGSEYDAKSDMYSLGVVLLELFQPLEQKWSEQKF

SEQ ID NO: 793822 - protein, 219 aa, Homo sapiens
LREGEGAGRSSAPQYVGYHTAWIEHVHVIQPRADRAAIELPSLEVLSDQEEDREQCGVKNDESSSSSIIFAEPTPEKEKRFGESDTENQNNKSVKYTTNLVIRESGELESTLELQENGLAGLSASSIVEQQLPLRRNSHLEESFTSTEESSEENVNFLGQTEAQYHLMLHIQMQLCELSLWDWIVERNKRGREYVDESACPYVMANVATKIFQELVDGV

SEQ ID NO: 793823 - protein, 118 aa, Homo sapiens [sequence omitted]

SEQ ID NO: 793824 - protein, 43 aa, Homo sapiens
CRILILLIHVTFSGIRALAVPFRLPMPICLPFRQAKVFFRHQA

SEQ ID NO: 793825 - protein, 90 aa, Homo sapiens
VLSGAVLPLWSALPQYKKKITDRCFHHSECYSGCCLMDLDSGGAFCAPRARITMICLPQTKGATNIICPCRMGLTCISKDLMCSRRCHMI

SEQ ID NO: 793826 - protein, 109 aa, Homo sapiens
KLHAPQVCVPVLSSRSLVTTKLLPVSMALPLWTSLVNGITQGSSMPQLLFFFFSFFFFFFFFEMESCSVAQAGVQWRDLGSLQPPPPGFMPFSCLSLLNSWDYRLPPPR

SEQ ID NO: 793827 - protein, 91 aa, Homo sapiens
NGGRLLLAGIQCFLVLGSIWKTCAPVVKMGCSSIPGTAPAATPSRPLTLTVRPLGVCYRRGTCGGPCAPGSAQALLHSTRRGQAGALEKSF

SEQ ID NO: 793828 - protein, 398 aa, Homo sapiens
MASPANSFVGTPYWMAPEVILAMDEGQYDGKVDVWSLGITCIELAERKPPLFNMNAMSALYHIAQNESPTLQSNEWSDYFRNFVDSCLQKIPQDRPTSEELLKHIFVLRERPETVLIDLIQRTKDAVRELDNLQYRKMKKLLFQEAHNGPAVEAQEEEEEQDHGVGRTGTVNSVGSNQSIPSMSISASSQSSSVNSLPDVSDDKSELDMMEGDHTVMSNSSVIHLKPEEENYREEGDPRTRASDPQSPPQVSRHKSHYRNREHFATIRTASLVTRQMQEHEQDSELREQMSGYKRMRRQHQKQLMTLENKLKAEMDEHRLRLDKDLETQRNNFAAEMEKLIKKHQAAMEKEAKVMSNEEKKFQQHIQAQQKKELNSFLESQKREYKLRKEQLKEVLMS

SEQ ID NO: 793829 - protein, 87 aa, Homo sapiens
YFYLSCFLCCQELNENQSTPKKEKQEWLSKQKENIQHFQAEEEANLLRRQRQYLELECRRFKRRMLLGRHNLEQDLVREVSLSDEKF

SEQ ID NO: 793830 - protein, 53 aa, Homo sapiens
MPSTNRAGSLKDPEIAELFFKEDPEKLFTDLREIGHGSFGAVYFVSVSGLMSV

SEQ ID NO: 793831 - protein, 1001 aa, Homo sapiens
MPSTNRAGSLKDPEIAELFFKEDPEKLFTDLREIGHGSFGAVYFARDVRTNEVVAIKKMSYSGKQSTEKWQDIIKEVKFLQRIKHPNSIEYKGCYLREHTAWLVMEYCLGSASDLLEVHKKPLQEVEIAAITHGALQGLAYLHSHTMIHRDIKAGNILLTEPGQVKLADFGSASMASPANSFVGTPYWMAPEVILAMDEGQYDGKVDVWSLGITCIELAERKPPLFNMNAMSALYHIAQNESPTLQSNEWSDYFRNFVDSCLQKIPQDRPTSEELLKHIFVLRERPETVLIDLIQRTKDAVRELDNLQYRKMKKLLFQEAHNGPAVEAQEEEEEQDHGVGRTGTVNSVGSNQSIPSMSISASSQSSSVNSLPDVSDDKSELDMMEGDHTVMSNSSVIHLKPEEENYREEGDPRTRASDPQSPPQVSRHKSHYRNREHFATIRTASLVTRQMQEHEQDSELREQMSGYKRMRRQHQKQLMTLENKLKAEMDEHRLRLDKDLETQRNNFAAEMEKLIKKHQAAMEKEAKVMSNEEKKFQQHIQAQQKKELNSFLESQKREYKLRKEQLKEELNENQSTPKKEKQEWLSKQKENIQHFQAEEEANLLRRQRQYLELECRRFKRRMLLGRHNLEQDLVREELNKRQTQKDLEHAMLLRQHESMQELEFRHLNTIQKMRCELIRLQHQTELTNQLEYNKRRERELRRKHVMEVRQQPKSLKSKELQIKKQFQDTCKIQTRQYKALRNHLLETTPKSEHKAVLKRLKEEQTRKLAILAEQYDHSINEMLSTQALRLDEAQEAECQVLKMQLQQELELLNAYQSKIKMQAEAQHDRELRELEQRVSLRRALLEQKIEEEMLALQNERTERIRSLLERQAREIEAFDSESMRLGFSNMVLSNLSPEAFSHSYPGASGWSHNPTGGPGPHWGHPMGGPPQAWGHPMQGGPQPWGHPSGPMQGVPRGSSMGVRNSPQALRRTASGGRTEQGMSRSTSVTSQISNGSHMSYT

SEQ ID NO: 793832 - protein, 633 aa, Homo sapiens
MASPANSFVGTPYWMAPEVILAMDEGQYDGKVDVWSLGITCIELAERKPPLFNMNAMSALYHIAQNESPTLQSNEWSDYFRNFVDSCLQKIPQDRPTSEELLKHIFVLRERPETVLIDLIQRTKDAVRELDNLQYRKMKKLLFQEAHNGPAVEAQEEEEEQDHGVGRTGTVNSVGSNQSIPSMSISASSQSSSVNSLPDVSDDKSELDMMEGDHTVMSNSSVIHLKPEEENYREEGDPRTRASDPQSPPQVSRHKSHYRNREHFATIRTASLVTRQMQEHEQDSELREQMSGYKRMRRQHQKQLMTLENKLKAEMDEHRLRLDKDLETQRNNFAAEMEKLIKKHQAAMEKEAKVMSNEEKKFQQHIQAQQKKELNSFLESQKREYKLRKEQLKEELNENQSTPKKEKQEWLSKQKENIQHFQAEEEANLLRRQRQYLELECRRFKRRMLLGRHNLEQDLVREELNKRQTQKDLEHAMLLRQHESMQELEFRHLNTIQKMRCELIRLQHQTELTNQLEYNKRRERELRRKHVMEVRQQPKSLKSKELQIKKQFQDTCKIQTRQYKALRNHLLETTPKSEHKAVLKRLKEEQTRKLAILAEQYDHSINEMLSTQAVSLLFLGQNKFSAPFLPPPE

SEQ ID NO: 793833 - protein, 749 aa, Homo sapiens
MSYSGKQSTEKWQDIIKEVKFLQRIKHPNSIEYKGCYLREHTAWLVMEYCLGSASDLLEVHKKPLQEVEIAAITHGALQGLAYLHSHTMIHRDIKAGNILLTEPGQVKLADFGSASMASPANSFVGTPYWMAPEVILAMDEGQYDGKVDVWSLGITCIELAERKPPLFNMNAMSALYHIAQNESPTLQSNEWSDYFRNFVDSCLQKIPQDRPTSEELLKHIFVLRERPETVLIDLIQRTKDAVRELDNLQYRKMKKLLFQEAHNGPAVEAQEEEEEQDHGVGRTGTVNSVGSNQSIPSMSISASSQSSSVNSLPDVSDDKSELDMMEGDHTVMSNSSVIHLKPEEENYREEGDPRTRASDPQSPPQVSRHKSHYRNREHFATIRTASLVTRQMQEHEQDSELREQMSGYKRMRRQHQKQLMTLENKLKAEMDEHRLRLDKDLETQRNNFAAEMEKLIKKHQAAMEKEAKVMSNEEKKFQQHIQAQQKKELNSFLESQKREYKLRKEQLKEELNENQSTPKKEKQEWLSKQKENIQHFQAEEEANLLRRQRQYLELECRRFKRRMLLGRHNLEQDLVREELNKRQTQKDLEHAMLLRQHESMQELEFRHLNTIQKMRCELIRLQHQTELTNQLEYNKRRERELRRKHVMEVRQQPKSLKSKELQIKKQFQDTCKIQTRQYKALRNHLLETTPKSEHKAVLKRLKEEQTRKLAILAEQYDHSINEMLSTQAVSLLFLGQNKFSAPFLPPPE

SEQ ID NO: 793834 - protein, 470 aa, Homo sapiens
MASPANSFVGTPYWMAPEVILAMDEGQYDGKVDVWSLGITCIELAERKPPLFNMNAMSALYHIAQNESPTLQSNEWSDYFRNFVDSCLQKIPQDRPTSEELLKHIFVLRERPETVLIDLIQRTKDAVRELDNLQYRKMKKLLFQEAHNGPAVEAQEEEEEQDHGVGRTGTVNSVGSNQSIPSMSISASSQSSSVNSLPDVSDDKSELDMMEGDHTVMSNSSVIHLKPEEENYREEGDPRTRASDPQSPPQVSRHKSHYRNREHFATIRTASLVTRQMQEHEQDSELREQMSGYKRMRRQHQKQLMTLENKLKAEMDEHRLRLDKDLETQRNNFAAEMEKLIKKHQAAMEKEAKVMSNEEKKFQQHIQAQQKKELNSFLESQKREYKLRKEQLKEELNENQSTPKKEKQEWLSKQKENIQHFQAEEEANLLRRQRQYLELECRRFKRRMLLGRHNLEQDLVREVSLSDEKF

SEQ ID NO: 793835 - protein, 36 aa, Homo sapiens
LLLYSGDIYFPFEKKILEEKPDGGISGTVAGSKKDV

SEQ ID NO: 793836 - protein, 103 aa, Homo sapiens
LLSNYNNLEGYILAEREHQEDRKEAEDISVKSSSVSVMCPTCVVLNATVSQLASYQDLSPVETATCRAPFQGQQGVGKMESLSLRKVFPIYAFEEGRSGTIIH

SEQ ID NO: 793837 - protein, 104 aa, Homo sapiens
VREVRGASARPPLLGGDIWTQTQTCSEGRLHEETRKMPFGGRGLSDTSTSQVLPRLPANHQKPGKGHGTDILLHSPHKEPTPLTPGFWTSSLPNCETINVCYFK

SEQ ID NO: 793838 - protein, 130 aa, Homo sapiens
PLLSPLASPPLGRCEKQPHLVNKWHVGEVGECLVRTLQGFSQEPSVHKVSGVFTRASPARAVPLLRCAPRLPKGERREERAGRAGWRIWTGPGGLGWGGLWPRLVLGPATSSRPRLRRGLRSWNGAARTQ

SEQ ID NO: 793839 - protein, 108 aa, Homo sapiens
MPGVTVKDVNQQEFIRALAAFLRKSGKLKVPEWVDTVKLLAKHKELAPYDENWLYTRAASTAWHLYLWGGAGVGSMTKIYGGCQRSGGMPGHFSRGSKNVAHRVLQRL

SEQ ID NO: 793840 - protein, 108 aa, Homo sapiens
IPDLTFQLNDKHLKTLSKTVFSETWLKGSTVVANDGFYVILKGLARPQTNVYKNLIEGSDSPDSFISQSFHSFIWSEEFKNSTLAEMYLPSYDSMVRDEYLLFPQATR

SEQ ID NO: 793841 - protein, 112 aa, Homo sapiens [sequence omitted]

SEQ ID NO: 793842 - protein, 111 aa, Homo sapiens
CEKREQHQQCTCKEERPCKDAKNEDGHPPTKERSIRRNKPANTLILDFQPPELSAAWATFQHKVTKDVPGMMKEESDYMLKEMVRGLASTYWQDLGNFGGCLIMGTGIKTG

SEQ ID NO: 793843 - protein, 77 aa, Homo sapiens
LKEEISPEGIIMLLNCLLQLPFPRAFPVLLRAEDGIFVITTVSSARLGRPGMHSYNMCDFEPGVHHIATRSLRETVL

SEQ ID NO: 793844 - protein, 131 aa, Homo sapiens
PDVEIKGPKMDIDAPDVEVQGPDWHLKMPKMKMPKFSMPGFKGEGREVDVNLPKADIDVSGPKVDVEVPDVSLEGPEGKLKGPKFKMPEMHFKAPKISMPDVDLNLKGPKLKGDVDVSLPEVEGEMKVPDV

SEQ ID NO: 793845 - protein, 104 aa, Homo sapiens
VILIPWPNLSSSGQRVQSGNLPERRRSGRETFLKDGAPARLACSPPADFLTLHTEGAGTASVQLAWSYPSGLAGPVAVSHSCYGLSCSLTPRRTPLGSERRELT

SEQ ID NO: 793846 - protein, 235 aa, Homo sapiens
THPSLWPDIISKCAKVTFTYTEFCPTPDNWFSIEPWLKVSNENLDYAILKLKENGNAFPPGLWRQISPQPSTGLIYLIGHPEGQIKKIDGCTVIPLNERLKKYPNDCQDGLVDLYDTTSNVYCMFTQRSFLSEVWNTHTLSYDTCFSDGSSGSPVFNASGKLVALHTFGLFYQRGFNVHALIEFGYSMDSILCDIKKTNESLYKSLNDEKLETYDEEKGKQESSLQDHQIEPMEC

SEQ ID NO: 793847 - protein, 110 aa, Homo sapiens
MCTVDLGWNSDQPLGRPRSWGLASLQSCTGGRGHSFCPRGRWREASCSSRGRDLLPTLPGWPLEHPGCAASYCDVAPVASSWRLYHMWVLIDILLFMLKFECRYKNTKSL

SEQ ID NO: 793848 - protein, 106 aa, Homo sapiens
LLPSKDVQSLSLPIMLAEILTTKVLKPVVELLSNPDYINQMLLAQLEYREQMNEHHKRAYTYSPSYEDFIKLINSNSDVEFLKQLRSVEGTVEKSGRRCVLVVFNN

SEQ ID NO: 793849 - protein, 141 aa, Homo sapiens
MLRFYLFISLLCLSRSDAEETCPSFTRLSFHSAVVGTGLNVRLMLYTRKNLTCAQTINSSAFGNLNVTKKTTFIVHGFRPTGSPPVWMDDLVKGLLSVEDMNVVVVDWNRGATTLIYTHASSKTRKVAMVLKEFIDQMLVR

SEQ ID NO: 793850 - protein, 80 aa, Homo sapiens
LLQRAFYSWVSSPAFPQAALLFALEIAPEAEVWRGTKNKLRRGSLPPGSGDLEEQVCLGGKGEVKETHTLFQQNQLLIYF

SEQ ID NO: 793851 - protein, 97 aa, Homo sapiens
KMNVLIYLLELGYTLPLPSLDNNSRLLGLWIPGLTSVAPLPEFSGLWARPESYTLGLPGSEAFRLGLSHATSIPGSPACIWLIVGLFAYHNHMSQFL

SEQ ID NO: 793852 - protein, 72 aa, Homo sapiens
GKRWQRGDITQSSHAPPVPEVEPKLQQERHLGSNVTFAAGEHRNLRPVTPPHSASLLLYRNHPCPRADGKVQ

SEQ ID NO: 793853 - protein, 247 aa, Homo sapiens
ALHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTV

SEQ ID NO: 793854 - protein, 86 aa, Homo sapiens
RKAELDGQGVRLQVSITLPVPRAWDNVLMVPPLCKEDDHSQCVHVLSANVTAQNVQKINTYARVGGLRRFCILLTDNLYKSSSQIL

SEQ ID NO: 793855 - protein, 88 aa, Homo sapiens
KAPVLLSRQRVGTAPHHGHGQRTTSPYRERLPSQPQFTRKCTSARSEITSLGMAWVAPPPHGPTHRDLNFWARDFFPIQQHFNHMSSS

SEQ ID NO: 793856 - protein, 71 aa, Homo sapiens
MPNSRGQKELGIKRNFKGTALTWAESACAIQLESQVLRQDVQMPQCRVLLINTCSPVLISNLTHPTLKAHL

SEQ ID NO: 793857 - protein, 67 aa, Homo sapiens
IPKEMSISSRAQTWLNIRVTCRSCPKPTQTSGFRRPTVGPPNLYLKQGTTLLEHGVSPECVMTENLR

SEQ ID NO: 793858 - protein, 95 aa, Homo sapiens
LEAYSDHTVRDISCVLATNTYLRCCLRSAMPTMASVKLSTLHPIVNHPHYEDADLRPGCSMLEIWDVEDPSNAANPPLRSILLEDARLEDASISE

SEQ ID NO: 793859 - protein, 84 aa, Homo sapiens
LDQNISHQQAIALLQQTTGSLRLIVAREPVHTKSSTSSSLNDTTLPETVCWGHVEEVELINDGSGLGFGIVGGKTSGVVVRTIV

SEQ ID NO: 793860 - protein, 102 aa, Homo sapiens
MSSAARSRQTAAGRVPRKTEPRESSGAHLPRCTAPSFHCGDSELWDWSAHRQTCAQVGVGAHPRQPGSGVYALVPRALKASLGKCFKAGKFTIHLCRRSLGF

SEQ ID NO: 793861 - protein, 112 aa, Homo sapiens
ALFLFLSLELESCYLALYLRARRERAGCLFEKTLVLRAKVSMCCLFLSGYKTKLYFKTEPSSSCIPVYLNILSTWCLNILILPCSFGLKVSILAGLYFLTKLAVHKLKNFHL

SEQ ID NO: 793862 - protein, 139 aa, Homo sapiens
NQIRKTSYAQHQQVRQIRKNRMEEWGACYNAENIPEGYNKGTEETKSPENPSKMPFPYKVLKALDPEIYRNVEFDVWLDSRKELQKSDYMEYAGRQYYLGDKCQVCLESEGRYYNAHIQEVGNENNSVTATFRYRARFD

SEQ ID NO: 793863 - protein, 191 aa, Homo sapiens
IFSSAVLYEILYKDVFVVDEEELKTAIKLFRSGSKKNRNNAVTGSEDAHTDYKSSNQNRMEEWGACYNAENIPEGYNKGTEETKSPENPSKMPFPYKVLKALDPEIYRNVEFDVWLDSRKELQKSDYMEYAGRQYYLGDKCQVCLESEGRYYNAHIQEVGNENNSVTVFIEELAEKHVVPLAIHRFYSATQ

SEQ ID NO: 793864 - protein, 176 aa, Homo sapiens
IFSSAVLYEILYKDVFVVDEEELKTAIKLFRSGSKKNRNNAVTGSEDAHTDYKSSNQNRMEEWGACYNAENIPEGYNKGTEETKSPENPSKMPFPYKVLKALDPEIYRNVEFDVWLDSRKELQKSDYMEYAGRQYYLGDKCQVCLESEGRYYNAHIQEVGNENNSVTVFIEELAEK

SEQ ID NO: 793865 - protein, 130 aa, Homo sapiens
IFSSAVLYEILYKDVFVVDEEELKTAIKLFRSGSKKNRNNAVTGSEDAHTDYKSSNQNRMEEWGACYNAENIPEGYNKGTEETKSPENPSKMPFPYKVLKALDPEIYRNVEFDVWLDSRKGLLGIRRKIL

SEQ ID NO: 793866 - protein, 72 aa, Homo sapiens
FNVAEGNEVLLLVHNLPQHLFGYSWYKGERVDGNRQIIGYVIGTQHAPPPRPANFFGLLVESGFHHVGQASL

SEQ ID NO: 793867 - protein, 137 aa, Homo sapiens
NASLPAHCSRQKFMGFKIALDDEGTAGGWLFWDDGQSIDTYGKGLYYLASFSASQNTMQSHIIFNNYITGTNPLKLGYIEIWGVGSVPVTSVSISVSGMVITPSFNNDPTTQVLSIDVTDRNISLHNFTSLTWISTL

SEQ ID NO: 793868 - protein, 96 aa, Homo sapiens
LQKEDTPPAKKEYLNTMQSHIIFNNYITGTNPLKLGYIEIWGVGSVPVTSVSISVSGMVITPSFNNDPTTQVLSIDVTDRNISLHNFTSLTWISTL

SEQ ID NO: 793869 - protein, 148 aa, Homo sapiens
MCSTHKSRDRGKGAIQEAITVLKTCGRVRRPPHRDAHSRRPSKTPNTHIPHLLPSPGSGTPSRGPRPLGWAQIALHPNKVSLLLSAANSKLTEKWAALGQRAPPSSRPLDGDAGVSYGCPAKAPVAEQEGCQRRHSALNNLGAWVSTR

SEQ ID NO: 793870 - protein, 91 aa, Homo sapiens
MEQKVNPSEVFRDNQHPSWGKGDSMNHHCPPPHRGNAEESMSLPHAGRKGHLHAQSTHPARSSQGPSYSQLQGRGPVGFISISPCLTWGLR

SEQ ID NO: 793871 - protein, 249 aa, Homo sapiens
TPGGPGRVNMAAQGSPSSSPSDDSTTSGSLPELPPTSTATSRSPPESKGSSRSSLLQWTCPEDSLPLAVFYGPLDAKNPLLASCEKEIQELLGFMRKKKALATTEEEKHEFRRRCATSLFNIWTKYAPRLPADYYNEKLLKVGDSLCQMKEYKLALLQCYGRYLQQFNTNFDENKVDVTQFKATFFPKGFKDKTAGLTFHALSGKNMCNYQLVCDSDENLKNKESVVQCLHILSSLRLIMQVALPQEHL

SEQ ID NO: 793872 - protein, 152 aa, Homo sapiens
SHPLSSPQQEENVREPLRPCFLTRRKVADTAMITPNLEAQTRVAPNPWGQGQKVDVATQTGKGHLGGEVRSRRCCATHPNSKDRDIHMDVPQIIRRPHALSPGRGDSSSDLPLSSQKLKSTKDMHGTRACTHTRLTHTSSSLSLQLGKEVER

SEQ ID NO: 793873 - protein, 70 aa, Homo sapiens
CSVIVLLVAALWAPRTGVPESHPALGPAAAVGPSSGSEDEQVHRPPAEPHLHASTRGLFIRLLLWSSVDC

SEQ ID NO: 793874 - protein, 75 aa, Homo sapiens
MPLQLDGLVESAFEGFPSPSSHHGLLPACPCRPRHLALGRYQVAAPGSHLPSTFISPPTDHRDRFLILLSCKCCT

SEQ ID NO: 793875 - protein, 190 aa, Homo sapiens [sequence omitted]

SEQ ID NO: 793876 - protein, 157 aa, Homo sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLASESAPLPPCHGAVPPHLSHPEAPTIHAASCYS

SEQ ID NO: 793877 - protein, 1114 aa, Homo sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRGPKSSPDEGSFLYTLPDDSTHQLLQPHHDCCQRQEQPAAVGQSGVRRAPDSPVLEAVWDPPFHSGPPCCLGLVPVEEVDSPDSCQVSGGDWCPQHPVGAYVGQEPGMQLSPGPLVRVSFETPPLTI

SEQ ID NO: 793878 - protein, 1114 aa, Homo sapiens; identical to SEQ ID NO: 793877

SEQ ID NO: 793879 - protein, 1114 aa, Homo sapiens; identical to SEQ ID NO: 793877

SEQ ID NO: 793880 - protein, 1010 aa, Homo sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITSCCSPITTAANARSSLLLWASQG

SEQ ID NO: 793881 - protein, 998 aa, Homo sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRAPMLLGPCAS

SEQ ID NO: 793882 - protein, 1114 aa, Homo sapiens; identical to SEQ ID NO: 793877

SEQ ID NO: 793883 - protein, 1092 aa, Homo sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRGPKSSPDEGSFLYTLPDDSTHQLLQPHHDCCQRQEQPAAVGQSGVRRAPDSPVLEAVWDPPFHSGPPCCLGLVPVEEVDSPDSCQRHKESYPLRLERENKEAAT

SEQ ID NO: 793884 - protein, 157 aa, Homo sapiens; identical to SEQ ID NO: 793876

SEQ ID NO: 793885 - protein, 870 aa, Homo sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKGEALWVLSPVLVFPAREGRVTIPCACAVLGLFPRKTLCFPNTLRLGHVSLSTHLSVPNTK

SEQ ID NO: 793886 - protein, 787 aa, Homo sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHVPGTWFITSMREQQGARYHSLETPTQMAGSGATGNIFLRCP

SEQ ID NO: 793887 - protein, 123 aa, Homo sapiens [sequence omitted]

SEQ ID NO: 793888 - protein, 122 aa, Homo sapiens
TNNDASMTNFLLATMSAGYISIIICASNISTCRRSSCHNNSSVHSISTFRERSGHNGKTVASSVNTSICKRRNSCNWNSIIRNSIISTCMRGSSYISNISTSASISSICLNRSTYIINSSTS

SEQ ID NO: 793889 - protein, 182 aa, Homo sapiens
YLRVLKEMIRGDLAGHFPGAKINVYTPGMLLGGTKRLTYMFCQIGEVNNPLGCQDTLFYSEVNFVSVEATVEVKWKPPLGTGCLCSCSTISVYCNEWGRRAAGYPECWNPSERKMESGGISSTTKTSSENGSCCFEKAARQVLILLLRLEYSGTIMANCSLELLGSGNPSVSASSEAGTSGG

SEQ ID NO: 793890 - protein, 235 aa, Homo sapiens
MSGGGEQLDILSVGILVKERWKVLRKIGGGGFGEIYDALDMLTRENVALKVESAQQPKQVLKMEVAVLKKLQGKDHVCRFIGCGRNDRFNYVVMQLQGRNLADLRRSQSRGTFTISTTLRLGRQILESIESIHSVGFLHRDIKPSNFAMGRFPSTCRKCYMLDFGLARQFTNSCGDVRPPRAVAGFRGTVRYASINAHRNREMGRHDDLWSLFYMLVEFVVGQLPWRKIKDKVIL

SEQ ID NO: 793891 - protein, 200 aa, Homo sapiens
MSGGGEQLDILSVGILVKERWKVLRKIGGGGFGEIYDALDMLTRENVALKVESAQQPKQVLKMEVAVLKKLQGKDHVCRFIGCGRNDRFNYVVMQLQGRNLADLRRSQSRGTFTISTTLRLGRQILESIESIHSVGFLHRDIKPPRAVAGFRGTVRYASINAHRNREMGRHDDLWSLFYMLVEFVVGQLPWRKIKDKVIL

SEQ ID NO: 793892 - protein, 183 aa, Homo sapiens
MSGGGEQLDILSVGILVKERWKVGKCCTEGGISSTTKTSSENGSCCFEKAARVGIWQIFAVASPEAHSPLVPLSGWVDRFWSLLKAFILWDSCIETSNRRTSLWVAFLVHVGNVTCLILAWLDNLPIPVVTSDHLELWQVFEGQFVMHQSTHIGTGKWEDMMTFGPYSTCWWSLWLVSCPGEK

SEQ ID NO: 793893 - protein, 288 aa, Homo sapiens
MGAVGTRRRRRQEGDWTRALLQKPLRPPRPRLNGNHPWELDACVAVLPYQCIAMSGGGEQLDILSVGILVKERWKVLRKIGGGGFGEIYDALDMLTRENVALKVESAQQPKQVLKMEVAVLKKLQGKDHVCRFIGCGRNDRFNYVVMQLQGRNLADLRRSQSRGTFTISTTLRLGRQILESIESIHSVGFLHRDIKPSNFAMGRFPSTCRKCYMLDFGLARQFTNSCGDVRPPRAVAGFRGTVRYASINAHRNREMGRHDDLWSLFYMLVEFVVGQLPWRKIKDKVIL

SEQ ID NO: 793894 - protein, 705 aa, Homo sapiens
MSDKLKKDLCYHNSDSPEYQDSSFSLIVAFTDAKYVFLGVSVRVLPKESSELGKADPPQCGWATSNRLPARINQAGEDGRADLLNLPAFIFLVCWMLPALKHQTPGSSSFGLSDLHQWFTRCSQAFSHTLKAEIVGFPTFEILKLGLSYCWLPCFSTYRWDFTYRSSKVDFESWTNQNSCPPVVPRLDLGSLVDSDDEDQNIIPENLPAPTDKCKLKYQQCKTEIKEGYKQYSQRNAENTKSNVTHKQSPRNKIDEKCVQDEEANTDDLTTLDRKAILQQGYADNSCDKQQRARKFDAEVVSIFTYLEIVAAEKKKQIVAEQVMIDHLSRAVISDPEQNLAIEQKESDHILPDSKMTPLRFRKRTLHETKIRTHSTLTENVLSHKLQFDGRIVSRNGRDACRELIGFFFTHDQSLTIYEYRQFGKNRTNVLPFIQKSIYSHQCGRRKGKQYRLGDFYVGATLTFLSSDHLSLPESIKENTLLKLRITNIDQIALDSLKTASMEQEDDIIIQETNDRLVFKAIQDVLKEKLHKRGVRILTGLGKYFQQLDKEGNGLLDKADFKQALKVFHLEVSEKDFESAWLILNDNGNGKVDYGEFKRGIIGEMNEYRKSYVRKAFMKLDFNKSGSVPIINIRKCYCAKKHSQVISGHSTEEEIKSSFLETLKVACSKSDEVSYGEFEDYYEGLSIGIVDDEDFVNILRTPWGI

SEQ ID NO: 793895 - protein, 128 aa, Homo sapiens
APASWHIPGSALQEEGQERSQMSLTIRKAHHLQDHSQAQGRLDLLPNCMLHAKEVKPPNDTDFLPLRALSLRTWSCWSPWKQKLLFTTSSSLFLAPHPSSFLPLLTPTCPPLYFLSSIFIPNFLSHLP

SEQ ID NO: 793896 - protein, 151 aa, Homo sapiens
TARRKSPCRTESCGTSAVALLTQVRSSDTVTPARRSPALVRSSDTVTPARRSPALVRSSDTVTPARRSPALGWVRAGTWASHSLRCGPASNSSLLGVMLKGVLDTSEVSVSSRSHPAYRIVLLWIKQDTAVLPYPWFCFPWPKILNRKFQK

SEQ ID NO: 793897 - protein, 82 aa, Homo sapiens
KIQKPSEDSQDNPEGKRESLREFQEKSHSRKTAASRKPEEGRGPTLSSHSDQLNEELNQKEPQQDQESEETSTISSVSLDSQ

SEQ ID NO: 793898 - protein, 76 aa, Homo sapiens
RCLLEAKAEASITWGVVSVWLKNGSRGPRECDCGNDGEAGRAGWRGKLEGTASRFQFVKNHLKDVSLKGKWASVKG

SEQ ID NO: 793899 - protein, 89 aa, Homo sapiens
KNPVEQLLFAYKLLDRAIGGINLNCMLTSLPNGSSVIDHCYAKRTHHIDGDTYKPLASNSFMMDLHLELIQAQHRIAVVLLDKLQGSSH

SEQ ID NO: 793900 - protein, 159 aa, Homo sapiens
KNPVEQLLFAYKLLDRAIGGINLNCMLTSLPNGSSVIDHCYAKRTHHIDGDTYKPLASNSFMMDLHLELIQAQHRIAVVLLDKLQVLQTPTVSKDISTKGPEKLKQSGSTDCFTELNIMNKIKKNTLSKAIYLMQKALLIFEKDATSTSSWELLMIHYI

SEQ ID NO: 793901 - protein, 154 aa, Homo sapiens
YKNSRKVAREHTISKKCRGVVIFSFLRMHSNQWKNADIMQDFIIFGKSILIILSLHSINSDIHFVESAIETSKTRPSFRSFNSRNNYGEIGVLQIAWALSSKKQRGIVCILRYWQDEKINLTYRMDWGRGELKTHKIIMGLLLIISTVKMERKK

SEQ ID NO: 793902 - protein, 154 aa, Homo sapiens; identical to SEQ ID NO: 793901

SEQ ID NO: 793903 - protein, 86 aa, Homo sapiens
LGLLDGQKVTVSTERPWAPSKPAASHRAAASIGAAGWARGLHALLLRGALDALGVKHMLGFLGFRSSTIKSVKWLNRKFASDDRFK

SEQ ID NO: 793904 - protein, 116 aa, Homo sapiens
RARALAGALRLPGSPCSLLGPRAQGPLRAELKPRRAAHGGSDPRASAFPLRRPPDPHLFSKLHSRLFFPAPGKLWKPAPPALRSGLAGVIHPFQVCGANTDAKISPRVCNNFQAER

SEQ ID NO: 793905 - protein, 107 aa, Homo sapiens
KARTPGDAHRPAHAGASEKGRRERARGLTRLGSAERMLSPAALPAGRGSRRSEAGGGALKQPPLTGAGSAAAAALSARALLKPGLACAAAPRRRRRLLCSSLSSSGR

SEQ ID NO: 793906 - protein, 121 aa, Homo sapiens
HIWMRRGVREPRAGREAFCILSWAVVTQVRTDTDKEGREGAACRGRSLPYRAGRSLHRCAQIWMRRGVREPRAGQQVLYILSWVVIAQVRTDTKIYQVVHSRFVNFILCKLYLKKEKKRKS

SEQ ID NO: 793907 - protein, 80 aa, Homo sapiens
ADEPVPFKAEMLQDNTKSSAQPENLIPMWSSDIVTGEKNEPVKPLQPLIKEQKPKDQSLALSPKLECSGTILAHSISALE

SEQ ID NO: 793908 - protein, 134 aa, Homo sapiens
TSILRKMHNMSKVTEVLETKWDARSQTQPQIWCSNHTRSSPHHSLSSTSPQLDKEEVHPSVTVVIGADLLEKNLAEIQNLRQRLEESISLNDRLRERLQHVLSNGDQGKGTAQSTVAPHSYTQSHSSGCGEDIL

SEQ ID NO: 793909 - protein, 102 aa, Homo sapiens
NSVLSATAANCYMCWISLVFPSSSTLLLPTKLTRMDHSSGLLCLLASEWVWPRSVLARDQRMVGCLFSALLLGLGGCLSSQRSLLPNSFPAFQVASPCTLPF

SEQ ID NO: 793910 - protein, 99 aa, Homo sapiens
MLEVNEENVSWGLLTNCSPHPNPPDGQGCVQGSGHKAPLAGQQLAHETALSAPPLNGSSMGSWKNTGAFSVSLLRSLAELQKYTTGNFSGTEMGPPPNT

SEQ ID NO: 793911 - protein, 67 aa, Homo sapiens
RTVGKPQALSEGFCRQSRRREEDIPTSPSLSPRFRTSTLQRAFGFCFSISEDWARHPPGSPRRRCSS

SEQ ID NO: 793912 - protein, 104 aa, Homo sapiens
MVVFVSVRRLDANHITSVPEDSFEGLVQLRHLWLDDNSLTEVPVHPLSNLPTLQALTLALNKISSIPDFAFTNLSSLVVLHLHNNKIRSLSQHCFDGLDNLETL

SEQ ID NO: 793913 - protein, 951 aa, Homo sapiens
MPGPLGLLCFLALGLLGSAGPSGAAPPLCAAPCSCDGDRRVDCSGKGLTAVPEGLSAFTQALDISMNNITQLPEDAFKNFPFLEELQLAGNDLSFIHPKALSGLKELKVLTLQNNQLKTVPSEAIRGLSALQSLRLDANHITSVPEDSFEGLVQLRHLWLDDNSLTEVPVHPLSNLPTLQALTLALNKISSIPDFAFTNLSSLVVLHLHNNKIRSLSQHCFDGLDNLETLDLSYNNLGEFPQAIKARPSLKELGFHSNSISVIPDGAFDGNPLLRTIHLYDNPLSFVGNSAFHNLSDLHSLVIRGASMVQQFPNLTGTVHLESLTLTGTKISSIPNNLCQEQKMLRTLDLSYNNIRDLPSFNGCHALEEISLQRNQIYQIKEGTFQGLISLRILDLSRNLIHEIHSRAFATLGPITNLDVSFNELTSFPTEGLNGLNQLKLVGNFKLKEALAAKDFVNLRSLSVPYAYQCCAFWGCDSYANLNTEDNSLQDHSVAQEKGTADAANVTSTLENEEHSQIIIHCTPSTGAFKPCEYLLGSWMIRLTVWFIFLVALFFNLLVILTTFASCTSLPSSKLFIGLISVSNLFMGIYTGILTFLDAVSWGRFAEFGIWWETGSGCKVAGFLAVFSSESAIFLLMLATVERSLSAKDIMKNGKSNHLKQFRVAALLAFLGATVAGCFPLFHRGEYSASPLCLPFPTGETPSLGFTVTLVLLNSLAFLLMAVIYTKLYCNLEKEDLSENSQSSMIKHVAWLIFTNCIFFCPVAFFSFAPLITAISISPEIMKSVTLIFFPLPACLNPVLYVFFNPKFKEDWKLLKRRVTKKSGSVSVSISSQGGCLEQDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 793914 - protein, 951 aa, Homo sapiens; identical to SEQ ID NO: 793913

SEQ ID NO: 793915 - protein, 903 aa, Homo sapiens
MPGPLGLLCFLALGLLGSAGPSGAAPPLCAAPCSCDGDRRVDCSGKGLTAVPEGLSAFTQALDISMNNITQLPEDAFKNFPFLEELRLDANHITSVPEDSFEGLVQLRHLWLDDNSLTEVPVHPLSNLPTLQALTLALNKISSIPDFAFTNLSSLVVLHLHNNKIRSLSQHCFDGLDNLETLDLSYNNLGEFPQAIKARPSLKELGFHSNSISVIPDGAFDGNPLLRTIHLYDNPLSFVGNSAFHNLSDLHSLVIRGASMVQQFPNLTGTVHLESLTLTGTKISSIPNNLCQEQKMLRTLDLSYNNIRDLPSFNGCHALEEISLQRNQIYQIKEGTFQGLISLRILDLSRNLIHEIHSRAFATLGPITNLDVSFNELTSFPTEGLNGLNQLKLVGNFKLKEALAAKDFVNLRSLSVPYAYQCCAFWGCDSYANLNTEDNSLQDHSVAQEKGTADAANVTSTLENEEHSQIIIHCTPSTGAFKPCEYLLGSWMIRLTVWFIFLVALFFNLLVILTTFASCTSLPSSKLFIGLISVSNLFMGIYTGILTFLDAVSWGRFAEFGIWWETGSGCKVAGFLAVFSSESAIFLLMLATVERSLSAKDIMKNGKSNHLKQFRVAALLAFLGATVAGCFPLFHRGEYSASPLCLPFPTGETPSLGFTVTLVLLNSLAFLLMAVIYTKLYCNLEKEDLSENSQSSMIKHVAWLIFTNCIFFCPVAFFSFAPLITAISISPEIMKSVTLIFFPLPACLNPVLYVFFNPKFKEDWKLLKRRVTKKSGSVSVSISSQGGCLEQDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 793916 - protein, 933 aa, Homo sapiens
MPGPLGLLCFLALGLLGSAGPSGAAPPLCAAPCSCDGDRRVDCSGKGLTAVPEGLSAFTQALDISMNNITQLPEDAFKNFPFLEELQLAGNDLSFIHPKALSGLKELKVLTLQNNQLKTVPSEAIRGLSALQSLRLDANHITSVPEDSFEGLVQLRHLWLDDNSLTEVPVHPLSNLPTLQALTLALNKISSIPDFAFTNLSSLVVLHLHNNKIRSLSQHCFDGLDNLETLDLSYNNLGEFPQAIKARPSLKELGFHSNSISVIPDGAFDGNPLLRTIHLYDNPLSFVGNSAFHNLSDLHSLVIRGASMVQQFPNLTGTVHLESLTLTGTKISSIPNNLCQEQKMLRTLDLSYNNIRDLPSFNGCHALEEISLQRNQIYQIKEGTFQGLISLRILDLSRNLIHEIHSRAFATLGPITNLDVSFNELTSFPTEGLNGLNQLKLVGNFKLKEALAAKDFVNLRSLSVPYAYQCCAFWGCDSYANLNTEDNSLQDHSVAQEKGTADAANVTSTLENEEHSQIIIHCTPSTGAFKPCEYLLGSWMIRLTVWFIFLVALFFNLLVILTTFASCTSLPSSKLFIGLISVSNLFMGIYTGILTFLDAVSWGRFAEFGIWWETGSGCKVAGFLAVFSSESAIFLLMLATVERSLSAKDIMKNGKSNHLKQFRVAALLAFLGATVAGCFPLFHRGEYSASPLCLPFPTGETPSLGFTVTLVLLNSLAFLLMAVIYTKLYCNLEKEDLSENSQSSMIKHVAWLIFTNCIFFCPVAFFSFAPLITAISISPEIMKSVTLIFFPLPACLNPVLYVFFNPKFKEDWKLLKRRVTKDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 793917 - protein, 951 aa, Homo sapiens; identical to SEQ ID NO: 793913

SEQ ID NO: 793918 - protein, 951 aa, Homo sapiens; identical to SEQ ID NO: 793913

SEQ ID NO: 793919 - protein, 951 aa, Homo sapiens; identical to SEQ ID NO: 793913

SEQ ID NO: 793920 - protein, 288 aa, Homo sapiens
SIDPLPRCRATVAGCFPLFHRGEYSASPLCLPFPTGETPSLGFTVTLVLLNSLAFLLMAVIYTKLYCNLEKEDLSENSQSSMIKHVAWLIFTNCIFFCPVAFFSFAPLITAISISPEIMKSVTLIFFPLPACLNPVLYVFFNPKFKEDWKLLKRRVTKKSGSVSVSISSQGGCLEQDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 793921 - protein, 951 aa, Homo sapiens; identical to SEQ ID NO: 793913

SEQ ID NO: 793922 - protein, 951 aa, Homo sapiens; identical to SEQ ID NO: 793913

SEQ ID NO: 793923 - protein, 951 aa, Homo sapiens; identical to SEQ ID NO: 793913

SEQ ID NO: 793924 - protein, 951 aa, Homo sapiens; identical to SEQ ID NO: 793913

SEQ ID NO: 793925 - protein, 230 aa, Homo sapiens [sequence omitted]

SEQ ID NO: 793926 - protein, 110 aa, Homo sapiens
MPGPLGLLCFLALGLLGSAGPSGAAPPLCAAPCSCDGDRRVDCSGKGLTAVPEGLSAFTQALDISMNNITQLPEDAFKNFPFLEELQLAGNDLSFIHPKALSGLKELKVL

SEQ ID NO: 793927 - protein, 115 aa, Homo sapiens
FLDIFTDICMIILCLLWGTQHFTIYLIFIPCKYVNLKTNLDIYTVVLVENKNLLLELQKTKSLKFFSPLGRIYNCSYFCEYFATLSYFQVHSRDETSFIFSYSCTVILNCLKHKI

SEQ ID NO: 793928 - protein, 87 aa, Homo sapiens
MKVLRAWLLCLLMLGLALRGAASRTHRHSMEIRTPDINPAWYASRGIRPVGRFGRRRATLGDVPKPGLRPRLTCFPLEGGAMSSQDG

SEQ ID NO: 793929 - protein, 243 aa, Homo sapiens
MESSAKIKREPPEIHRAGMVPSRSCPSITHGPRLSSVPRTRRRAVHISIMEGLESLRDSAHSTPVRSTSHGDTFLPHVRSSRTDSNERVAVIADEAYSPADSVLPTPVAEHSLELMLLSRQINGATCSIEEEKESEASTPTATEVEALGGELRALCQGHSGPEEEQVNKFVLSVLRLLLVTMGLLFVLLLLLIILTESDLDIAFFRDIRQTPEFEQFHYQYFCPLRRWFACKIRSVVSLLIDT

SEQ ID NO: 793930 - protein, 574 aa, Homo sapiens
MLSRLMSGSSRSLEREYSCTVRLLDDSEYTCTIQRDAKGQYLFDLLCHHLNLLEKDYFGIRFVDPDKQRHWLEFTKSVVKQLRSQPPFTMCFRVKFYPADPAALKEEITRYLVFLQIKRDLYHGRLLCKTSDAALLAAYILQAEIGDYDSGKHPEGYSSKFQFFPKHSEKLERKIAEIHKTELSGQTPATSELNFLRKAQTLETYGVDPHPCKDVSGNAAFLAFTPFGFVVLQGNKRVHFIKWNEVTKLKFEGKTFYLYVSQKEEKKIILTYFAPTPEACKHLWKCGIENQAFYKLEKSSQVRTVSSSNLFFKGSRFRYREIVTGRVAKEVMESSAKIKREPPEIHRAGMVPSRSCPSITHGPRLSSVPRTRRRAVHISIMEGLESLRDSAHSTPVRSTSHGDTFLPHVRSSRTDSNERVAVIADEAYSPADSVLPTPVAEHSLELMLLSRQINGATCSIEEEKESEASTPTATEVEALGGELRALCQGHSGPEEEQVNKFVLSVLRLLLVTMGLLFVLLLLLIILTESDLDIAFFRDIRQTPEFEQFHYQYFCPLRRWFACKIRSVVSLLIDT

SEQ ID NO: 793931 - protein, 574 aa, Homo sapiens
MVQVLMSGSSRSLEREYSCTVRLLDDSEYTCTIQRDAKGQYLFDLLCHHLNLLEKDYFGIRFVDPDKQRHWLEFTKSVVKQLRSQPPFTMCFRVKFYPADPAALKEEITRYLVFLQIKRDLYHGRLLCKTSDAALLAAYILQAEIGDYDSGKHPEGYSSKFQFFPKHSEKLERKIAEIHKTELSGQTPATSELNFLRKAQTLETYGVDPHPCKDVSGNAAFLAFTPFGFVVLQGNKRVHFIKWNEVTKLKFEGKTFYLYVSQKEEKKIILTYFAPTPEACKHLWKCGIENQAFYKLEKSSQVRTVSSSNLFFKGSRFRYRKIVTGRVAKEVMESSAKIKREPPEIHRAGMVPSRSCPSITHGPRLSSVPRTRRRAVHISIMEGLESLRDSAHSTPVRSTSHGDTFLPHVRSSRTDSNERVAVIADEAYSPADSVLPTPVAEHSLELMLLSRQINGATCSIEEEKESEASTPTATEVEALGGELRALCQGHSGPEEEQVNKFVLSVLRLLLVTMGLLFVLLLLLIILTESDLDIAFFRDIRQTPEFEQFHYQYFCPLRRWFACKIRSVVSLLIDT

SEQ ID NO: 793932 - protein, 301 aa, Homo sapiens
MLSRLMSGSSRSLEREYSCTVRLLDDSEYTCTIQRDAKGQYLFDLLCHHLNLLEKDYFGIRFVDPDKQRHWLEFTKSVVKQLRSQPPFTMCFRVKFYPADPAALKEEITRYLVFLQIKRDLYHGRLLCKTSDAALLAAYILQAEIGDYDSGKHPEGYSSKFQFFPKHSEKLERKIAEIHKTELSGQTPATSELNFLRKAQTLETYGVDPHPCKVRPPGWRLHDLSSSRRHQEQEPPCLRSEAPFNVYMAGTFSEISEKMPALKTPLDHMLHNFVVPHQCQRNRGKVNLNNKSKARAPQWVI

SEQ ID NO: 793933 - protein, 51 aa, Homo sapiens
MLSRLMSGSSRSLEREYSCTVRLLDDSEYTCTIQVSAAPPRPARGTPLSPK

SEQ ID NO: 793934 - protein, 54 aa, Homo sapiens
MCQCLVLRLGEREGSAGEMVMGHSLGDKRVGMICGADIEVQGKRVTPSCSVLRK

SEQ ID NO: 793935 - protein, 109 aa, Homo sapiens
LVVVHCSAGIGHTGRFIVINSLIDIIREKGINCNIDLLKTIHTVQSQRSGMAQTEAQYRFIYMAVQHYIETLQHKIEEEQKSKRKGHEYKNIKYSLADQTSGAQSPLPP

SEQ ID NO: 793936 - protein, 109 aa, Homo sapiens
KRSISVEVTRFSRCRLSPLSLTRKGNSLNPCASRVRQCLTLFGSRSVLHPLSCAHSLALPSEMNPVPQMEMQKSPVFCVTHAGSCRPELFLFGHLGCPQKIKILRKGHC

SEQ ID NO: 793937 - protein, 129 aa, Homo sapiens
VAGWKRLPQITGQLPASLSLLRPRERAGGREASPISTLNWGCFLVTHLPDFLQQTTLNSSVPPSSRGDIPVGKGRRLEGGCPARAVQGDPRTGDAGCTAQGRTNRTFCLQAFVIKEIGVSQGNSSSDEQ

SEQ ID NO: 793938 - protein, 83 aa, Homo sapiens
AVAQATHCILCILCSSHFPTSVSLVAGTAGMHPYAQLIFVETEYRLVAQGGLNSWAQGDLPTSASQSAGLAWEGNFQNVSFGK

SEQ ID NO: 793939 - protein, 924 aa, Homo sapiens
MNFIKDNSRALIQRMGMTVIKQITDDLFVWNVLNREEVNIICCEKVEQDAARGIIHMILKKGSESCNLFLKSLKEWNYPLFQDLNGQSLFHQTSEGDLDDLAQDLKDLYHTPSFLNFYPLGEDIDIIFNLKSTFTEPVLWRKDQHHHRVEQLTLNGLLQALQSPCIIEGESGKGKSTLLQRIAMLWGSGKCKALTKFKFVFFLRLSRAQGGLFETLCDQLLDIPGTIRKQTFMAMLLKLRQRVLFLLDGYNEFKPQNCPEIEALIKENHRFKNMVIVTTTTECLRHIRQFGALTAEVGDMTEDSAQALIREVLIKELAEGLLLQIQKSRCLRNLMKTPLFVVITCAIQMGESEFHSHTQTTLFHTFYDLLIQKNKHKHKGVAASDFIRSLDHCGDLALEGVFSHKFDFELQDVSSVNEDVLLTTGLLCKYTAQRFKPKYKFFHKSFQEYTAGRRLSSLLTSHEPEEVTKGNGYLQKMVSISDITSTYSSLLRYTCGSSVEATRAVMKHLAAVYQHGCLLGLSIAKRPLWRQESLQSVKNTTEQEILKAININSFVECGIHLYQESTSKSALSQEFEAFFQGKSLYINSGNIPDYLFDFFEHLPNCASALDFIKLDFYGGAMASWEKAAEDTGGIHMEEAPETYIPSRAVSLFFNWKQEFRTLEVTLRDFSKLNKQDIRYLGKIFSSATSLRLQIKRCAGVAGSLSLVLSTCKNIYSLMVEASPLTIEDERHITSVTNLKTLSIHDLQNQRLPGGLTDSLGNLKNLTKLIMDNIKMNEEDAIKLAEGLKNLKKMCLFHLTHLSDIGEGMDYIVKSLSSEPCDLEEIQLVSCCLSANAVKILAQNLHNLVKLSILDLSENYLEKDGNEALHELIDRMNVLEQLTALMLPWGCDVQGSLSSLLKHLEEVTTTRQAWVEKLETHRYRD

SEQ ID NO: 793940 - protein, 92 aa, Homo sapiens
MNFIKDNSRALIQRMGMTVIKQITDDLFVWNVLNREEVNIICCEKVEQDAARGIIHMILKKGSESCNLFLKSLKEWNYPLFQDLNGQSLLTA

SEQ ID NO: 793941 - protein, 1024 aa, Homo sapiens
MNFIKDNSRALIQRMGMTVIKQITDDLFVWNVLNREEVNIICCEKVEQDAARGIIHMILKKGSESCNLFLKSLKEWNYPLFQDLNGQSLFHQTSEGDLDDLAQDLKDLYHTPSFLNFYPLGEDIDIIFNLKSTFTEPVLWRKDQHHHRVEQLTLNGLLQALQSPCIIEGESGKGKSTLLQRIAMLWGSGKCKALTKFKFVFFLRLSRAQGGLFETLCDQLLDIPGTIRKQTFMAMLLKLRQRVLFLLDGYNEFKPQNCPEIEALIKENHRFKNMVIVTTTTECLRHIRQFGALTAEVGDMTEDSAQALIREVLIKELAEGLLLQIQKSRCLRNLMKTPLFVVITCAIQMGESEFHSHTQTTLFHTFYDLLIQKNKHKHKGVAASDFIRSLDHCGDLALEGVFSHKFDFELQDVSSVNEDVLLTTGLLCKYTAQRFKPKYKFFHKSFQEYTAGRRLSSLLTSHEPEEVTKGNGYLQKMVSISDITSTYSSLLRYTCGSSVEATRAVMKHLAAVYQHGCLLGLSIAKRPLWRQESLQSVKNTTEQEILKAININSFVECGIHLYQESTSKSALSQEFEAFFQGKSLYINSGNIPDYLFDFFEHLPNCASALDFIKLDFYGGAMASWEKAAEDTGGIHMEEAPETYIPSRAVSLFFNWKQEFRTLEVTLRDFSKLNKQDIRYLGKIFSSATSLRLQIKRCAGVAGSLSLVLSTCKNIYSLMVEASPLTIEDERHITSVTNLKTLSIHDLQNQRLPGGLTDSLGNLKNLTKLIMDNIKMNEEDAIKLAEGLKNLKKMCLFHLTHLSDIGEGMDYIVKSLSSEPCDLEEIQLVSCCLSANAVKILAQNLHNLVKLSILDLSENYLEKDGNEALHELIDRMNVLEQLTALMLPWGCDVQGSLSSLLKHLEEVPQLVKLGLKNWRLTDTEIRILGAFFGKNPLKNFQQLNLAGNRVSSDGWLAFMGVFENLKQLVFFDFSTKEFLPDPALVRKLSQVLSKLTFLQEARLVGWQFDDDDLSVITGAFKLVTA

SEQ ID NO: 793942 - protein, 1024 aa, Homo sapiens; identical to SEQ ID NO: 793941

SEQ ID NO: 793943 - protein, 924 aa, Homo sapiens
MNFIKDNSRALIQRMGMTVIKQITDDLFVWNVLNREEVNIICCEKVEQDAARGIIHMILKKGSESCNLFLKSLKEWNYPLFQDLNGQSLFHQTSEGDLDDLAQDLKDLYHTPSFLNFYPLGEDIDIIFNLKSTFTEPVLWRKDQHHHRVEQLTLNGLLQALQSPCIIEGESGKGKSTLLQRIAMLWGSGKCKALTKFKFVFFLRLSRAQGGLFETLCDQLLDIPGTIRKQTFMAMLLKLRQRVLFLLDGYNEFKPQNCPEIEALIKENHRFKNMVIVTTTTECLRHIRQFGALTAEVGDMTEDSAQALIREVLIKELAEGLLLQIQKSRCLRNLMKTPLFVVITCAIQMGESEFHSHTQTTLFHTFYDLLIQKNKHKHKGVAASDFIRSLDHCGDLALEGVFSHKFDFELQDVSSVNEDVLLTTGLLCKYTAQRFKPKYKFFHKSFQEYTAGRRLSSLLTSHEPEEVTKGNGYLQKMVSISDITSTYSSLLRYTCGSSVEATRAVMKHLAAVYQHGCLLGLSIAKRPLWRQESLQSVKNTTEQEILKAININSFVECGIHLYQESTSKSALSQEFEAFFQGKSLYINSGNIPDYLFDFFEHLPNCASALDFIKLDFYGGAMASWEKAAEDTGGIHMEEAPETYIPSRAVSLFFNWKQEFRTLEVTLRDFSKLNKQDIRYLGKIFSSATSLRLQIKRCAGVAGSLSLVLSTCKNIYSLMVEASPLTIEDERHITSVTNLKTLSIHDLQNQRLPGGLTDSLGNLKNLTKLIMDNIKMNEEDAIKLAEGLKNLKKMCLFHLTHLSDIGEGMDYIVKSLSSEPCDLEEIQLVSCCLSANAVKILAQNLHNLVKLSILDLSENYLEKDGNEALHELIDRMNVLEQLTALMLPWGCDVQGSLSSLLKHLEEVPQLVKLGLKNWRLTDTEI

SEQ ID NO: 793944 - protein, 156 aa, Homo sapiens
MNFIKDNSRALIQRMGMTVIKQITDDLFVWNVLNREEVNIICCEKVEQDAARGIIHMILKKGSESCNLFLKSLKEWNYPLFQDLNGQSLFHQTSEGDLDDLAQDLKDLYHTPSFLNFYPLGEDIDIIFNLKSTFTEPVLWRKDQHHHRVEQLTLVL

SEQ ID NO: 793945 - protein, 841 aa, Homo sapiens
MLWGSGKCKALTKFKFVFFLRLSRAQGGLFETLCDQLLDIPGTIRKQTFMAMLLKLRQRVLFLLDGYNEFKPQNCPEIEALIKENHRFKNMVIVTTTTECLRHIRQFGALTAEVGDMTEDSAQALIREVLIKELAEGLLLQIQKSRCLRNLMKTPLFVVITCAIQMGESEFHSHTQTTLFHTFYDLLIQKNKHKHKGVAASDFIRSLDHCGDLALEGVFSHKFDFELQDVSSVNEDVLLTTGLLCKYTAQRFKPKYKFFHKSFQEYTAGRRLSSLLTSHEPEEVTKGNGYLQKMVSISDITSTYSSLLRYTCGSSVEATRAVMKHLAAVYQHGCLLGLSIAKRPLWRQESLQSVKNTTEQEILKAININSFVECGIHLYQESTSKSALSQEFEAFFQGKSLYINSGNIPDYLFDFFEHLPNCASALDFIKLDFYGGAMASWEKAAEDTGGIHMEEAPETYIPSRAVSLFFNWKQEFRTLEVTLRDFSKLNKQDIRYLGKIFSSATSLRLQIKRCAGVAGSLSLVLSTCKNIYSLMVEASPLTIEDERHITSVTNLKTLSIHDLQNQRLPGGLTDSLGNLKNLTKLIMDNIKMNEEDAIKLAEGLKNLKKMCLFHLTHLSDIGEGMDYIVKSLSSEPCDLEEIQLVSCCLSANAVKILAQNLHNLVKLSILDLSENYLEKDGNEALHELIDRMNVLEQLTALMLPWGCDVQGSLSSLLKHLEEVPQLVKLGLKNWRLTDTEIRILGAFFGKNPLKNFQQLNLAGNRVSSDGWLAFMGVFENLKQLVFFDFSTKEFLPDPALVRKLSQVLSKLTFLQEARLVGWQFDDDDLSVITGAFKLVTA

SEQ ID NO: 793946 - protein, 359 aa, Homo sapiens
MNFIKDNSRALIQRMGMTVIKQITDDLFVWNVLNREEVNIICCEKVEQDAARGIIHMILKKGSESCNLFLKSLKEWNYPLFQDLNGQSGLTDSLGNLKNLTKLIMDNIKMNEEDAIKLAEGLKNLKKMCLFHLTHLSDIGEGMDYIVKSLSSEPCDLEEIQLVSCCLSANAVKILAQNLHNLVKLSILDLSENYLEKDGNEALHELIDRMNVLEQLTALMLPWGCDVQGSLSSLLKHLEEVPQLVKLGLKNWRLTDTEIRILGAFFGKNPLKNFQQLNLAGNRVSSDGWLAFMGVFENLKQLVFFDFSTKEFLPDPALVRKLSQVLSKLTFLQEARLVGWQFDDDDLSVITGAFKLVTA

SEQ ID NO: 793947 - protein, 245 aa, Homo sapiens
RLRPLVQAELSVLVDVLHRPELLFPENTDARRKCESGGFICKLIKHTKQLLEENEEKLCIKVLQTLREMMTKDRGYGEKGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSR

SEQ ID NO: 793948 - protein, 544 aa, Homo sapiens
MDSRYLQLQLYLPSCSLLQGSGDSSLEKEFLGAPVGPSVSTPNSQHSSPSRSLSANSIKVEMYSDEESSRLLGPDERLLEKDDSVIVEDSLSEPLGYCDGSGPEPHSPGGIRLPNGKLKCDVCGMVCIGPNVLMVHKRSHTGERPFHCNQCGASFTQKGNLLRHIKLHSGEKPFKCPFCNYACRRRDALTGHLRTHSVSSPTVGKPYKCNYCGRSYKQQSTLEEHKERCHNYLQSLSTEAQALAGQPGDEIRDLEMVPDSMLHSSSERPTFIDRLANSLTKRKRSTPQKFVGEKQMRFSLSDLPYDVNSGGYEKDVELVAHHSLEPGFGSSLAFVGAEHLRPLRLPPTNCISELTPVISSVYTQMQPLPGRLELPGSREAGEGPEDLADGGPLLYRPRGPLTDPGASPSNGCQDSTDTESNHEDRVAGVVSLPQGPPPQPPPTIVVGRHSPAYAKEDPKPQEGLLRGTPGPSKEVLRVVGESGEPVKAFKCEHCRILFLDHVMFTIHMGCHGFRDPFECNICGYHSQDRYEFSSHIVRGEHKVG

SEQ ID NO: 793949 - protein, 483 aa, Homo sapiens
MYSDEESSRLLGPDERLLEKDDSVIVEDSLSEPLGYCDGSGPEPHSPGGIRLPNGKLKCDVCGMVCIGPNVLMVHKRSHTGERPFHCNQCGASFTQKGNLLRHIKLHSGEKPFKCPFCNYACRRRDALTGHLRTHSVSSPTVGKPYKCNYCGRSYKQQSTLEEHKERCHNYLQSLSTEAQALAGQPGDEIRDLEMVPDSMLHSSSERPTFIDRLANSLTKRKRSTPQKFVGEKQMRFSLSDLPYDVNSGGYEKDVELVAHHSLEPGFGSSLAFVGAEHLRPLRLPPTNCISELTPVISSVYTQMQPLPGRLELPGSREAGEGPEDLADGGPLLYRPRGPLTDPGASPSNGCQDSTDTESNHEDRVAGVVSLPQGPPPQPPPTIVVGRHSPAYAKEDPKPQEGLLRGTPGPSKEVLRVVGESGEPVKAFKCEHCRILFLDHVMFTIHMGCHGFRDPFECNICGYHSQDRYEFSSHIVRGEHKVG

SEQ ID NO: 793950 - protein, 532 aa, Homo sapiens
MESLFCESSGDSSLEKEFLGAPVGPSVSTPNSQHSSPSRSLSANSIKVEMYSDEESSRLLGPDERLLEKDDSVIVEDSLSEPLGYCDGSGPEPHSPGGIRLPNGKLKCDVCGMVCIGPNVLMVHKRSHTGERPFHCNQCGASFTQKGNLLRHIKLHSGEKPFKCPFCNYACRRRDALTGHLRTHSVSSPTVGKPYKCNYCGRSYKQQSTLEEHKERCHNYLQSLSTEAQALAGQPGDEIRDLEMVPDSMLHSSSERPTFIDRLANSLTKRKRSTPQKFVGEKQMRFSLSDLPYDVNSGGYEKDVELVAHHSLEPGFGSSLAFVGAEHLRPLRLPPTNCISELTPVISSVYTQMQPLPGRLELPGSREAGEGPEDLADGGPLLYRPRGPLTDPGASPSNGCQDSTDTESNHEDRVAGVVSLPQGPPPQPPPTIVVGRHSPAYAKEDPKPQEGLLRGTPGPSKEVLRVVGESGEPVKAFKCEHCRILFLDHVMFTIHMGCHGFRDPFECNICGYHSQDRYEFSSHIVRGEHKVG

SEQ ID NO: 793951 - protein, 532 aa, Homo sapiens; identical to SEQ ID NO: 793950

SEQ ID NO: 793952 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 793953 - protein, 77 aa, Homo sapiens
PVIGTECEHLLPGRPNEGCFHSKTHSHQMLLGRCMEQLPRHSHGALTTWLFGKAVWPHQAQFRKNKYINDSIAQEEK

SEQ ID NO: 793954 - protein, 146 aa, Homo sapiens
MVCACLIASEIFLTAEERLYYFGERRTDKTNGTKYQGVETPSQNRYVGYFAQVKHSYNWNLPPRKTLFIKRLVIYSIHGVGTGDGYDLKVQIVMKKKIVFSCTSLNSCRVFHDTETDRVIIDVFNCPPLYDDVKVQASSSALSTKK

SEQ ID NO: 793955 - protein, 119 aa, Homo sapiens
ASQHCSSACYSSEGTCLLARTLSGPRNLASVCPRVSTLPPAGAPRAPKPGRRPLRAGRFQTAPVQRHPSFGFLHPASASAPESDKQKRFSATQGLVCYTQNVPGTGTKVFYKIINFYGL

SEQ ID NO: 793956 - protein, 103 aa, Homo sapiens
ASQHCSSACYSSEGTCLLARTLSGPRNLASVCPRVSTLPPAGAPRAPKPGRRPLRAGRFQTAPVQRHPSFGFLHPASASAPESDKQKRFSATQGLLPPWDDTA

SEQ ID NO: 793957 - protein, 114 aa, Homo sapiens
HFFPSLFHLALPSMAHLIHLCHLHVQVQGQQWYVMLAAVPKHQQSVYCCPSTKPGAVKGEGEGSLGHLTLVSTQNETPGCSPPTYIQDCCLQSLFETSEMSSFPYASPNKVTSI

SEQ ID NO: 793958 - protein, 140 aa, Homo sapiens
MGLDAINDAMLLEVCIYHLLKLYFLEQPYYLDLIELFLQSSYQTEIGQTLDLITAPQGNVDLGRFTEKRYKSIVKYKAAFYSYLPELQPCTAGIDGDKEHANGKKILLEMGEFFQIQDDYLDLFGDPSVTSKVGTDIQDN

SEQ ID NO: 793959 - protein, 75 aa, Homo sapiens
LEQVDQFLKNRKLPELLAEKSQEMLHKLDNVTFTHYLHAPGICDAKNHLQPVNSLCYFNEPVWELAPSFFLSNPL

SEQ ID NO: 793960 - protein, 406 aa, Homo sapiens
MAKYVSLTEANEELKVLMDENQTSRPVAVHTSTVNPLGKQLLPKTFGQSSVNIDQQVVIGYASETSSIKHPCGRKPKPTQHSLCLSEPAFLLLTSLGRAAQQERREEWHGPVPSFHEGLGDGAEERDHFLPRQVVGELVAKFRAASNHASPNESAYDVKNIKRRTYDALNVLMAMNIISREKKKIKWIGLTTNSAQNCQNLRVERQKRLERIKQKQSELQQLILQQIAFKNLVLRNQYVEEQVSQRPLPNSVIHVPFIIISSSKKTVINCSISDDKSEYLFKFNSSFEIHDDTEVLMWMGMTFGLESGSCSAEDLKMARNLVPKALEPYVTEMAQGTFGGVFTTAGSRSNGTWLSASDLTNIAIGMLATSSGGSQYSGSRVETPAVEEEEEEDNNDDDLSENDEDD

SEQ ID NO: 793961 - protein, 111 aa, Homo sapiens
ITFIRFLSSMNSLMFSKGRVHPEGLPTFITFKGFLSSVNSLMLKETCTLIKGFSTFIAFIGFLSTVDILVFGKVCPAHKGFFTNVTFKRFLSSMYSMMMGKVYISDKSFST

SEQ ID NO: 793962 - protein, 83 aa, Homo sapiens
MLVSSSERFFLLLGLKNLLVVVNSRVLGRPPMPHREENFFTHLLILEMSFNQRQVLYFTVRGSMQDPQKRAHGHNSTLVEGLE

SEQ ID NO: 793963 - protein, 50 aa, Homo sapiens
KTHIPMSTNTLTLTSSLIHRHLFPSDAHLLTHLQLLTHACMRGPLHPSVS

SEQ ID NO: 793964 - protein, 52 aa, Homo sapiens
RRRHAPKSPSRDLKEKKEVVEEAENGRDAPANGNANEENGEQEADDVKEMKK

SEQ ID NO: 793965 - protein, 58 aa, Homo sapiens
RRRHAPKSPSRDLKEKKEVVEEAENGRDAPANGNANEENALMTSSLMKRRLRPLLEML

SEQ ID NO: 793966 - protein, 150 aa, Homo sapiens
LHLPGSSSPPTSASLVVGTTGTHYHAQLIFCIYGRDAVSPCCPGWSQSNPELKRSACFGLPKCWDYKHEPPCLVLGGIFYNVIRVRLYGNMTCEQSLEGSEIMKPCEYEKNILGQGNNRSKDSKLEEYLLEEQGGLGSWAIVNEWDCSER

SEQ ID NO: 793967 - protein, 171 aa, Homo sapiens
GIGGSCKQKSVVGGRQVSKENVSVKEAQGTGGGFVRQLEPKEGRPSPRKAYVGEGYDGRMSELQPGTTTPWKVQLEKKVSEAVDMGIGCWRNPLLLLIALVLSAKLGHFQRWEGFQQKLMSKKNMNSTLNFFIQSYNNASNDTYLYRVQRLIRSQMQMEFRSCCPRWSAMA

SEQ ID NO: 793968 - protein, 75 aa, Homo sapiens
LLQKSLKWQMLQVGFQSMSVILTCHTAKLTSCPMQEEHTSVACGSMGKTVGCIILCCLDLTAELPFLSPVTHIQE

SEQ ID NO: 793969 - protein, 113 aa, Homo sapiens
LSEGIQYNSLPTRILNSQQRGKKKLMVLLCICLNFYRNVKGVNLLQVQSCAFTKGQERSPKARHDSTGSSLCLPFYTMSDKEAVLSSWASVSCVNSEVSEATMMSLLLKTTVG

SEQ ID NO: 793970 - protein, 68 aa, Homo sapiens
ETPLKPPLSSRTGPLPPYLDSHPPTPAFFCLGSPKVESELTLLGERFFMVFSFIKPNYSLLSRNGNAS

SEQ ID NO: 793971 - protein, 75 aa, Homo sapiens
LKSLVLDAITLTLLQRLYQILRREILPQKRPGNLTSGRISSLWECGIGVIEVNDKDVVFLKLTPDELGEMKPDIL

SEQ ID NO: 793972 - protein, 129 aa, Homo sapiens
MATFPGQVSTYFLAAWTGPGPATHWPLYAQLMPHSGLSRPSSCPGTSSPGPKLPQVGLSRPSCCLPAFSPGLALPPGCIYKTNSCLTTTFYGSAPAQLLPAFVGPKLPQVKLFRPTFCLAVACTDPALA

SEQ ID NO: 793973 - protein, 94 aa, Homo sapiens
RILSVAHSIQLNVAHARAWHLSELARSLTHSLENSRILAALRVHPVPTRSWVPCALDTDVLRPDSGITAKFKSQLFQGPGQSAWLLCASISSSV

SEQ ID NO: 793974 - protein, 45 aa, Homo sapiens
GQRSEGVGQGKVVLHVTVPVPTHGWGEGAASKPTVLPPPPPTRCS

SEQ ID NO: 793975 - protein, 49 aa, Homo sapiens
KLPIIDDQIRWTLLHSLHVPQPLSSICTVDPPFLKNSQSGVVGHACNSG

SEQ ID NO: 793976 - protein, 202 aa, Homo sapiens
MSASTSSHRPIKGILKNKSSSGSSVATSGQQSGGTIQDVKRKKSQKWDESSILAAHRATYRDYDLMKANEPGTSYMSVQDNGEDSVRDVEGEDSVRGVEGKEATDASDHSCEVDEQESSEAYMRKILLHKQEKKRQFEMRRRLHYNEELNIKLARQLMWKELQSEDNENEETPQGTNEEKTAAEESEEAPLTGGLQTQSCDP

SEQ ID NO: 793977 - protein, 202 aa, Homo sapiens; identical to SEQ ID NO: 793976

SEQ ID NO: 793978 - protein, 113 aa, Homo sapiens
MSRLMLRRNPSCQRETTVEQQTTSWRQIKKLSQMMDENLRNADKHQNESWYYDSGITIAGVFHYKTGLTQDKHVLLIRPIHTNLGRAIQPACNNPQTQYNDRPDHRLSIQTPH

SEQ ID NO: 793979 - protein, 113 aa, Homo sapiens
MSRLMLRRNPSCQRETTVEQQTTSWRQIKKLSQMMDENLRNADKHQNESWSYDSGITIAGVFHYKTGLTQDKHVLLIRPIHTNLGRAIQPACNNPQTQYNDRPDHRLSIQTPH

SEQ ID NO: 793980 - protein, 72 aa, Homo sapiens
MAGLEHFTIAFQDDSPSQEALTFTGSRHTPAQTQRLWSSRVSSPCLQSEGAGGLLVAARRSSSSPFSARGAC

SEQ ID NO: 793981 - protein, 77 aa, Homo sapiens
QVAYVRARELHTLEVTGLETVAQSKAHVASLEGLIPEDKVVLLAGSPLQNEATLGQCGVEALTTLEVVGRRLGVHNV

SEQ ID NO: 793982 - protein, 151 aa, Homo sapiens
WRSEPSRAAPRRASPKTGRNAAGTCGLARSARACLPAGAQRLRRLRAGVPIKRHPTPSRGPRPAPGCQLPPKRSCLREMHGAGGKARGAPGGSQTLRGREVAPQSQPLEPTQWVGSALTLGLPQSVLSLYYSNYGIFNFLKKIRNRKAQKA

SEQ ID NO: 793983 - protein, 105 aa, Homo sapiens
MLIRPLRWKSIPEDREERRGDLWLSALRPGLSARGGAAAEAAPGRSSNQAPPNSQSGAEASAGMPASPKKILPQGNAWSRRKSPRRPRRIADPKGAGGGAPVPTS

SEQ ID NO: 793984 - protein, 110 aa, Homo sapiens
PFWGRRGWSRVTAGQDPGSRRPEHLLGSARKQPPASRLLQGNRRPGPFLSFTYLCRNQNALSSLSAENISVVPRRQSLLHLSSSPFSLTRTRTLILDSLLSCGLRNHFAA

SEQ ID NO: 793985 - protein, 117 aa, Homo sapiens
GVLRPVAPCPFSRSGRGRQPLRDSTYSQPSLECRGPGRGLQSCDDTCIPGVMEGKGRLWRGWELGYLQACLLTHVLAELVRGGEPPLQPSVGALGSCCWAPAAPGHTSGRRASSHTA

SEQ ID NO: 793986 - protein, 107 aa, Homo sapiens
LKKKEKNNFPVHKRSAFTECKNRFSLLVCKVLSHLTLSAKRALPAPFLPVWAPLPGEAAPWCCPVLPACLPSGSRPEAFGGSVGAPHVPSAQPSAGAEMVLRKDLEK

SEQ ID NO: 793987 - protein, 82 aa, Homo sapiens
YSACCKALPAQAWERGVPYTAVSPEWTQTARGSSPQPRLHSAAQPVPAATIGVLLGTQTTVKVEKLRPSSKKCLVEGHEGRK

SEQ ID NO: 793988 - protein, 107 aa, Homo sapiens
MVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSEAHNFNS

SEQ ID NO: 793989 - protein, 212 aa, Homo sapiens
MAAAAGMLLLGLLQAGGSVLGQAMEKVTGGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKNVFEALSEAHNFNS

SEQ ID NO: 793990 - protein, 234 aa, Homo sapiens
RGGGDERGAVGIGREAREGSDDWGRGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIISEQLMKVAVMQLMSQHQLSTSVLASNQTTIESVFIDRRTLEMCFNTSISALLDISLC

SEQ ID NO: 793991 - protein, 268 aa, Homo sapiens
RGGGDERGAVGIGREAREGSDDWGRGNLLSMLLIACAFTLSLVYLIRLAAGHLVQLPAGVKSPPYIFSPIPFLGHAIAFGKSPIEFLENAYEKYGPVFSFTMVGKTFTYLLGSDAAALLFNSKNEDLNAEDVYSRLTTPVFGKGVAYDVPNPVFLEQKKMLKSGLNIAHFKQHVSIIEKETKEYFESWGESGEKMHGKEIRSQLNEKVAQLYADLDGGFSHAAWLLPGWLPLPSFRRRDRAHREIKDISIRQSRNADSLQKKFDHILQ

SEQ ID NO: 793992 - protein, 74 aa, Homo sapiens
AWPSGNCSFQLAERSALGGVTLGAPRPRQRGRRAEYAGSHAATGRTPKLLERHSHALLLLPSSKVVQEQFPPIL

SEQ ID NO: 793993 - protein, 33 aa, Homo sapiens
MGKDFMSKTPKAMATKAKIDKWDLIKLKSFCTA

SEQ ID NO: 793994 - protein, 458 aa, Homo sapiens
ERGLETNSCSEEELSSPGRGGGGGGRLLLQPPGPELPPVPFPLQDLVPLGRLSRGEQQQQQQQQPPPPPPPPGPLRPLAGPSRKGSFKIRLSRLFRTKSCNGGSGGGDGTGKRPSGELAASAASLTDMGGSAGRELDAGRKPKLTRTQSAFSPVSFSPLFTGETVSLVDVDISQRGLTSPHPPTPPPPPRRSLSLLDDISGTLPTSVLVAPMGSSLQSFPLPPPPPPHAPDAFPRIAPIRAAESLHSQPPQHLQCPLYRPDSSSFAASLRELEKCGWYWGPMNWEDAEMKLKGKPDGSFLVRDSSDPRYILSLSFRSQGITHHTRMEHYRGTFSLWCHPKFEDRCQSVVEFIKRAIMHSKNGKFLYFLRSRVPGLPPTPVQLLYPVSRFSNVKSLQHLCRFRIRQLVRIDHIPDLPLPKPLISYIRKFYYYDPQEEVYLSLKEAQLISKQKQEVEPST

SEQ ID NO: 793995 - protein, 106 aa, Homo sapiens
WPGSHALLAATRPPMRQRPEASRCWSPTSKVHRPLQATEPKKTGHVKAQEAGSLCLPFLAGAFHAGSKSGKVMPLTAKKAPSRDQSHRHRSPTPETTSLWRTRTPS

SEQ ID NO: 793996 - protein, 87 aa, Homo sapiens
PDVSRSLSARQLARMSESSPESREELESEDSYNGRGQGELSSEDIVESSSPRKRENTVQAKKTGAKPSQARKVNKRKSPPGSNPNLS

SEQ ID NO: 793997 - protein, 67 aa, Homo sapiens
MALSQTRRTPATQFYPVRMIRGLGRTSLTYSQTLNGVRSRLLGYKSEVNRIRCCAVVAITPERGGSR

SEQ ID NO: 793998 - protein, 73 aa, Homo sapiens
SSSIKTGQTKGHFPNGWVFLVHLMLPTELPPGDGNAPCQESPLDPASSQSQSPCQTGPRVTLEGDRPNLEISC

SEQ ID NO: 793999 - protein, 161 aa, Homo sapiens
DEFEDLEWSEEVQKLQEQQLRSDLLDQYRSLLVERNRSQRYNLYLQHKIFEALRRKKGLEAAEVADRGAEAEAPEKEQAYLRHLGMLEELKKQQADDLQWYHQELGQLKRQCQEKLTRVEKEWRRFQALKKQVVMQAMGSCRMRGGRQAALREVEQIQALE

SEQ ID NO: 794000 - protein, 41 aa, Homo sapiens
PAYSLPSASLVQTACKETYVGSMHCPDVTPGPKNPWTHCRD

SEQ ID NO: 794001 - protein, 40 aa, Homo sapiens
GTWGAALGYLTLQQTRRTHPTLHIRKSFFFSSPTPTHPTP

SEQ ID NO: 794002 - protein, 114 aa, Homo sapiens
GSRQKHRTPAPASASALHSQHTLRFLSGCSLLSLVMGSLSVQSHAPVSLCVTFKLSPCVCLCENMCVWVCHRRKTFILAANIWKHLENKQYLLKNIKGSKKQDKKQTVVKFQLL

SEQ ID NO: 794003 - protein, 370 aa, Homo sapiens
MASSTTRGPRVSDLFSGLPPAVTTPANQSAEASAGNGSVAGADAPAVTPFQSLQLVHQLKGLIVLLYSVVVVVGLVGNCLLVLVIARVRRLHNVTNFLIGNLALSDVLMCTACVPLTLAYAFEPRGWVFGGGLCHLVFFLQPVTVYVSVFTLTTIAVDRYVVLVHPLRRRISLRLSAYAVLAIWALSAVLALPAAVHTYHVELKPHDVRLCEEFWGSQERQRQLYAWGLLLVTYLLPLLVILLSYVRVSVKLRNRVVPGCVTQSQADWDRARRRRTFCLLVVVVVVFAVCWLPLHVFNLLRDLDPHAIDPYAFGLVQLLCHWLAMSSACYNPFIYAWLHDSFREELRKLLVAWPRKIAPHGQNMTVSVVI

SEQ ID NO: 794004 - protein, 105 aa, Homo sapiens
AAPLQRGASSWKGCVCAPRPCPRGGDNPRLQPGVPLLLGPQPRLRPAEAPGPGREREAPPCRLNPLGKGPGGRGWDVPGPTKASAPPLRAACRGDRAGRPPPPRP

SEQ ID NO: 794005 - protein, 654 aa, Homo sapiens
ENSDKTIGDGDIFTHLNSHTEVTACECNQCGKPLHHKQALIQQQKIHTRESLYLFSDYVNVFSPKSHAFAHESICAEEKQHECHECEAVFTQKSQLDGSQRVYAGICTEYEKDFSLKSNRQKTPYEGNYYKCSDYGRAFIQKSDLFRCQRIHSGEKPYEYSECEKNLPQNSNLNIHKKIHTGGKHFECTECGKAFTRKSTLSMHQKIHTGEKPYVCTECGKAFIRKSHFITHERIHTGEKPYECSDCGKSFIKKSQLHVHQRIHTGENPFICSECGKVFTHKTNLIIHQKIHTGERPYICTVCGKAFTDRSNLIKHQKIHTGEKPYKCSDCGKSFTWKSRLRIHQKCHTGERHYECSECGKAFIQKSTLSMHQRIHRGEKPYVCTECGKAFFHKSHFITHERIHTGEKPYECSICGKSFTKKSQLHVHQQIHTGEKPYRCAECGKAFTDRSNLFTHQKIHTGEKPYKCSDCGKAFTRKSGLHIHQQSHTGERHYECSECGKAFARKSTLIMHQRIHTGEKPYICNECGKSFIQKSHLNRHRRIHTGEKPYECSDCGKSFIKKSQLHEHHRIHTGEKPYICAECGKAFTIRSNLIKHQKIHTKQKPYKCSDLGKALNWKPQLSMPQKSDNGEVECSMPQLWCGDSEGDQGQLSSI

SEQ ID NO: 794006 - protein, 191 aa, Homo sapiens
AGVCLRTDAQALATGLVVRNCSSFPCFKMKSKNYSTEPNNLRARNSFRYNGLIHRKTVGVEPAADGKGVVVVIKRRSGQRKPATSYVRTTINKNARATLSSIRHMARDIATMCVPCVPCWPGWSRTPDLVISPPRPPALSRTCSSPSSQGHQAQVSPAQRTPRQRTLTLCHKAAPQLLLQAISHATALCPG

SEQ ID NO: 794007 - protein, 115 aa, Homo sapiens
FRKCHSKICQFGIWVNSSQRHLKNNKCKEKLSLNSPYLPKDRSSKRSSVVINPLPGNFINRGRLTLSQEKRLEVDTTPRQTSSKTIISSSEDPIIFPKNYFSPKLPISHLLSPVK

SEQ ID NO: 794008 - protein, 124 aa, Homo sapiens
EIDMATEGDVELELETETSGPERPPEKPRKHDSGAADLERVTDYAEEKEIQSSNLETAMSVIGDRRSREQKAKQEREKELAKVTIKKEDLELIMTEMEISRAAAERSLREHMGNVVEALIALTN

SEQ ID NO: 794009 - protein, 124 aa, Homo sapiens; identical to SEQ ID NO: 794008

SEQ ID NO: 794010 - protein, 99 aa, Homo sapiens
EIDMATEGDVELELETETSGPERPPEKPRKHDSGAADLERVTDYAEEKEIQSSNLETAMSVIGDRRSREQKAKQEREKELAKVTIKKEDLELIEIKWDS

SEQ ID NO: 794011 - protein, 121 aa, Homo sapiens
EIDMATEGDVELELETETSGPERPPEKPRKHDSGAADLERVTDYAEEKEIQSSNLETAMSVIGDRRSREQKAKQEREKELAKVTIKKEDLELIMTEPIRRALAPNRHHPAKSPRSPTPKHI

SEQ ID NO: 794012 - protein, 751 aa, Homo sapiens
MIHKHLNKLQIVCLSNYLSIYEPNPYGLIFNHLSIPYCFPEKRARCSASCPIPAKPVIPTFWEVEVSGSLEIQEFETSLSNMVKHHLYKNKPPKSKNWSSMLLCVCSPDYQEAEVGGLIEIREVKAAVSHDRTTVLHPGDRMRPIFLFYFNFFFFIETVSLCHPGWSAVALSRLTASSASWVHAILLPQPPEELGLQAPPTTPGYFFVFLVEMGFHHVSQVGLDLLTSCSTRLGLPKCWDYRREPLRLAETLILKKKKKNYFRSVIVLTPVIPALWETEAGGLLETRSLKPPGQYSETPSLQKNFFKISQTWWRAPAVLAIWEAEVEESLEAQKFEITVSCDPAPLHSSLGKRVRSCLCVLFFWTGSLLFRLECRGTVVAHCSLGQQAYTTGTHNQMLSPCVAQVGLQLQLSSNPPTLTPTKCWDYRHNPLSLAYFNFKENNFLSLLVCSRMTTLFQVLNLYNKVGCRMSASVYQQGLANEIQGCPYFLSEWAELNAIRKMLFLVPLTLEGSVQMALPKSAKGSTFLVYLHPVQASGASACYAQILHDGVGCTLLYEILRKETDDIEVIGTLDLFATIRIGGHLKGGDEQLTQNEVVSFRFLRMWGIIFIYSYEYFYYDCGIKCDIVEKAQALISGQPVFELWLYLYHLCSFFIYEIVHISNSHGDEMSHRSSTSTQGQHNVRAKHIRVLISFFFFLRWESCCVTQAGVQWCDLGSLHALPPGFQRLSCLSLPSSWDYRCPPPRPANFLYF

SEQ ID NO: 794013 - protein, 67 aa, Homo sapiens
FTWRAPWCPEREPELSVLQMDTGEPQHGSRWCPERERVKLLTLKARQSLPCSCRCRGDRSRRAGANG

SEQ ID NO: 794014 - protein, 121 aa, Homo sapiens
GFLASPQYCPTSPLYFSHPGNQDNNRIYSQQCCEDLEHCVRESPLLSAWHVGKSGWKNMLPLITVPPSESFQDIKNSRGDEVHAANTITLYLKTQSLEEKNNFRWIYDYVRNQAGRGGSCM

SEQ ID NO: 794015 - protein, 525 aa, Homo sapiens
MSCSSRASSSRAGGSSSARVSAGGSSFSSGSRCGLGGSSAQGFRGGASSCSLSGGSSGAFGGSFGGGFGSCSVGGGFGGASGSGTGFGGGSSFGGVSGFGRGSGFCGSSRFSSGATGGFYSYGGGMGGGVGDGGLFSGGEKQTMQNLNDRLANYLDKVRALEEANTDLENKIKEWYDKYGPGSGDGGSGRDYSKYYSIIEDLRNQIIAATVENAGIILHIDNARLAADDFRLKYENELCLRQSVEADINGLRKVLDDLTMTRSDLEMQIESFTEELAYLRKNHEEEMKNMQGSSGGEVTVEMNAAPGTDLTKLLNDMRAQYEELAEQNRREAEERFNKQSASLQAQISTDAGAATSAKNEITELKRTLQALEIELQSQLAMKSSLEGTLADTEAGYVAQLSEIQTQISALEEEICQIWGETKCQNAEYKQLLDIKTRLEVEIETYRRLLDGEGGGSSFAEFGGRNSGSVNMGSRDLVSGDSRSGSCSGQGRDSSKTRVTKTIVEELVDGKVVSSQVSSISEVKVK

SEQ ID NO: 794016 - protein, 587 aa, Homo sapiens
DGRAHSRRGGPTAPPGPEAKRGAASVPGPTASAPAPGPRAHPMATDAALRRLLRLHRTEIAVAVDSAFPLLHALADHDVVPEDKFQETLHLKEKEGCPQAFHALLSWLLTQDSTAILDFWRVLFKDYNLERYGRLQPILDSFPKDVDLSQPRKGRKPPAVPKALVPPPRLPTKRKASEEARAAAPAALTPRGTASPGSQLKAKPPKKPESSAEQQRLPLGNGIQTMSASVQRAVAMSSGDVPGARGAVEGILIQQVFESGGSKKCIQVGGEFYTPSKFEDSGSGKNKARSSSGPKPLVRAKGAQGAAPGGGEARLGQQGSVPAPLALPSDPQLHQKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 794017 - protein, 348 aa, Homo sapiens
MWLVYSSGAPGTQQPARNRVFFPIGMAPGGVCWRPDGWGTGGQGRISGPGSMGAGQRLGSSGTQRCCWGSCFGKEVALRRVLHPSPVCMGVSCLCQKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 794018 - protein, 254 aa, Homo sapiens
MWLVYSSGAPGTQQPARNRVFFPIGMAPGGVCWRPDGWGTGGQGRISGPGSMGAGQRLGSSGTQRCCWGSCFGKEVALRRVLHPSPVCMGVSCLCQKNEDECAVCRDGGELICCDGCPRAFHLACLSPPLREIPSGTWRCSSCLQATVQEVQPRAEEPRPQEPPVETPLPPGLRSAGEEPRCQGWTPRPCTPYCVWVLRVSRTWLLVRVAGCAEMVRTCCGVLTAPLPSTGAATSQPAPPGPGRACAADPAQET

SEQ ID NO: 794019 - protein, 245 aa, Homo sapiens
MLEGQLEAREPKEGTHPEDPCPGAGAAMEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISPLSADEETTPKYAGRKSQSATLLGQRWSSNHLAPPKPMSLKTERINSGKTPPQEDREKSPPGRRQDRSPAPTGRPTPGAERREVSEDGKIMHPSSRSLQNSGGRKSPVQASQAAT

SEQ ID NO: 794020 - protein, 77 aa, Homo sapiens
EMRREDLGTAVGTRPRCSGPSRSDWRGPGCWRVSSRPGSPRRAPTQRTRARELGLPWRRHLQQPRSPGRTAMPGRCR

SEQ ID NO: 794021 - protein, 238 aa, Homo sapiens
MLEGQLEAREPKEGTHPEDPCPGAGAAMEKTPAAAEVPREDSNAGEMPSLQQQITSLHQELGRQQSLWADIHRKLQSHMDALRKQNRELREELRGLQRQQWEAGKKPAASPHAGRESHTLALEPAFGKISPLSADEETTPKYAGRKSQSATLLGQRWSSNHLAPPKPMSLKTERINSGKTPPQEDREKSPPGRRQDRSPAPTGRPTPGAERREVSEDGKVTSETWVTLHWQHGKFRFR

SEQ ID NO: 794022 - protein, 108 aa, Homo sapiens
NFLESASPGPAPPASQWPLSAQPSSWLSAVFPGPAFDFWWPLQAQNLTSSALAGPASCLSKAYTGPASASQWTLHAQLSSRLTAASPVQSSCVSATSAGPAPAGQWPL

SEQ ID NO: 794023 - protein, 231 aa, Homo sapiens
MGPPLWPDLQEPPPPGTSSQIRSPLLCDVIKPAPHHDVTVRVVPPPRFLPLLLRPLPSDGDIAMRRDRGPKPALGGAGEVEPGGMAASPTGRPRRLQRYLQSGEFDQFRDFPIFESNFVQVTRLGEVANEVTMGVAASSPALELPDLLLLAGPAKENGHLQLFGLFPLKFVQLFVHDKSRCQLEVKLNTSRTFYLQLRAPLKTRDREFGQWVRLLYRLRFLSASAVPFTQE

SEQ ID NO: 794024 - protein, 247 aa, Homo sapiens
MGPPLWPDLQEPPPPGTSSQIRSPLLCDVIKPAPHHDVTVRVVPPPRFLPLLLRPLPSDGDIAMRRDRGPKPALGGAGEVEPGGMAASPTGRPRRLQRYLQSGEFDQFRDFPIFESNFVQFCPDIYPAPTSDLWPQVTRLGEVANEVTMGVAASSPALELPDLLLLAGPAKENGHLQLFGLFPLKFVQLFVHDKSRCQLEVKLNTSRTFYLQLRAPLKTRDREFGQWVRLLYRLRFLSASAVPFTQE

SEQ ID NO: 794025 - protein, 247 aa, Homo sapiens; identical to SEQ ID NO: 794024

SEQ ID NO: 794026 - protein, 215 aa, Homo sapiens
MGPPLWPDLQEPPPPGTSSQIRSPLLCDVIKPAPHHDVTVRVVPPPRFLPLLLRPLPSDGDIAMRRDRGPKPALGGAGEVEPGGMAASPTGRPRRLQRYLQSGEFDQFRDFPIFESNFVQFCPDIYPAPTSDLLAPGDSVGRSCQRGHHGGGSLQSSPGAPGPIASGRPCQGERTPATLRLRAPLKTRDREFGQWVRLLYRLRFLSASAVPFTQE

SEQ ID NO: 794027 - protein, 247 aa, Homo sapiens; identical to SEQ ID NO: 794024

SEQ ID NO: 794028 - protein, 82 aa, Homo sapiens
SPAQPPSVCNSPKDPRPATSVDRARYAQLKSTHPSRTSPGPAAAAPGSTGRCYRHQQEQEQPGCPSAGCRHLGFFPPAKGRL

SEQ ID NO: 794029 - protein, 129 aa, Homo sapiens
ALTHFQLLLCAALFLFSVFCQPENCFPTVGQAVQQCLQILASFVDIFCSFSRERERDWVRLRHPTTCVFKANLAAKGSWKLLGLQLLLHVSKSKTQLVSINRLSTSDVCKVKVGRWKLHLLTIQRLVDA

SEQ ID NO: 794030 - protein, 138 aa, Homo sapiens
WWGLVLQFRQPLAPGSAGGIPSLREGRPGLGVCPGKGRWKPLCLSWLPLLAQLCPHWGRQPLHSPLEEPGRVWVGAGVEEGSRRLAAGSPCCSQPLGRSAGWGTISQGGGPSVRIGGLLFFPLPPHSSLGDRARLCPP

SEQ ID NO: 794031 - protein, 235 aa, Homo sapiens
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQVLLSCSHVFHKACLQAFEKFTNKKTCPLCRKNQYQTRVIHDGARLFRIKCVTRIQAYWRGCVVRKWYRNLRKTVPPTDAKLRKKFFEKKTQDWKPA

SEQ ID NO: 794032 - protein, 362 aa, Homo sapiens
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQVLLSCSHVFHKACLQAFEKFTNKKTCPLCRKNQYQTRVIHDGARLFRIKCVTRIQAYWRGCVVRKWYRNLRKTVPPTDAKLRKKFFEKKFTEISHRILCSYNTNIEELFAEIDQCLAINRSVLQQLEEKCGHEITEEEWEKIQVQALRRETHECSICLAPLSAAGGQRVGAGRRSREMALLSCSHVFHHACLLALEEFSVGDRPPFHACPLCRSCYQKKILEC

SEQ ID NO: 794033 - protein, 362 aa, Homo sapiens; identical to SEQ ID NO: 794032

SEQ ID NO: 794034 - protein, 362 aa, Homo sapiens; identical to SEQ ID NO: 794032

SEQ ID NO: 794035 - protein, 140 aa, Homo sapiens
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQV

SEQ ID NO: 794036 - protein, 149 aa, Homo sapiens
MLKNKGHSSKKDNLAVNAVALQDHILHDLQLRNLSVADHSKTQVQKKENKSLKRDTKAIIDTGLKKTTQCPKLEDSEKEYVLDPKPPPLTLAQKLGLIGPPPPPLSSDEWEKVKQRSLLQGDSVQPCPICKEEFELRPQNPSLLERMCC

SEQ ID NO: 794037 - protein, 362 aa, Homo sapiens; identical to SEQ ID NO: 794032

SEQ ID NO: 794038 - protein, 140 aa, Homo sapiens; identical to SEQ ID NO: 794035

SEQ ID NO: 794039 - protein, 198 aa, Homo sapiens
MCSTKKNQYQTRVIHDGARLFRIKCVTRIQAYWRGCVVRKWYRNLRKTVPPTDAKLRKKFFEKKFTEISHRILCSYNTNIEELFAEIDQCLAINRSVLQQLEEKCGHEITEEEWEKIQVQALRRETHECSICLAPLSAAGGQRVGAGRRSREMALLSCSHVFHHACLLALEEFSVGDRPPFHACPLCRSCYQKKILEC

SEQ ID NO: 794040 - protein, 251 aa, Homo sapiens [sequence omitted]

SEQ ID NO: 794041 - protein, 192 aa, Homo sapiens [sequence omitted]

SEQ ID NO: 794042 - protein, 105 aa, Homo sapiens
MLKNKGHSSKKDNLAVNAVALQDHILHDLQLRNLSVADHSKTQVQKKENKSLKRDTKAIIDTGLKKTTQCPKLEDSEKEYVLDPKPPPLTLGYQFIGCTANFKPV

SEQ ID NO: 794043 - protein, 139 aa, Homo sapiens
ETRKVTKIDGQARERFPATSTELRCELYPPPPPPQFTEISHRILCSYNTNIEELFAEIDQCLAINRSVLQQLEEKCGHEITEEEWEKIQVQVGLAGSLATSRLSCSCRGCGEWHVGGGRGLTLGSLGVSGPGCSRGGCG

SEQ ID NO: 794044 - protein, 1297 aa, Homo sapiens
HPLDKRTGERELGGKSGEDRRGAPAGATSFPAAPSPLPLHTHARSLAGARTPPAPDPHLGGRHTLGSPSRGSRSGMEAARTERPAGRPGAPLVRTGLLLLSTWVLAGAEITWDATGGPGRPAAPASRPPALSPLSPRAVASQWPEELASARRAAVLGRRAGPELLPQQGGGRGGEMQVEAGGTSPAGERRGRGIPAPAKLGGARRSRRAQPPITQERGDAWATAPADGSRGSRPLAKGSREEVKAPRAGGSAAEDLRLPSTSFALTGDSAHNQAMVHWSGHNSSVILILTKLYDFNLGSVTESSLWRSTDYGTTYEKLNDKVGLKTVLSYLYVNPTNKRKIMLLSDPEMESSILISSDEGATYQKYRLTFYIQSLLFHPKQEDWVLAYSLDQKLYSSMDFGRRWQLMHERITPNRFYWSVAGLDKEADLVHMEVRTTDGYAHYLTCRIQECAETTRSGPFARSIDISSLVVQDEYIFIQVTTSGRASYYVSYRREAFAQIKLPKYSLPKDMHIISTDENQVFAAVQEWNQNDTYNLYISDTRGIYFTLAMENIKSSRGLMGNIIIELYEVAGIKGIFLANKKVDDQVKTYITYNKGRDWRLLQAPDVDLRGSPVHCLLPFCSLHLHLQLSENPYSSGRISSKETAPGLVVATGNIGPELSYTDIGVFISSDGGNTWRQIFDEEYNVWFLDWGGALVAMKHTPLPVRHLWVSFDEGHSWDKYGFTSVPLFVDGALVEAGMETHIMTVFGHFSLRSEWQLVKVDYKSIFSRHCTKEDYQTWHLLNQGEPCVMGERKIFKKRKPGAQCALGRDHSGSVVSEPCVCANWDFECDYGYERHGESQCVPAFWYNPASPSKDCSLGQSYLNSTGYRRIVSNNCTDGLREKYTAKAQMCPGKAPRGLHVVTTDGRLVAEQGHNATFIILMEEGDLQRTNIQLDFGDGIAVSYANFSPIEDGIKHVYKSAGIFQVTAYAENNLGSDTAVLFLHVVCPVEHVHLRVPFVAIRNKEVNISAVVWPSQLGTLTYFWWFGNSTKPLITLDSSISFTFLAEGTDTITVQVAAGNALIQDTKEIAVHEYFQSQLLSFSPNLDYHNPDIPEWRKDIGNVIKRALVKVTSVPEDQILIAVFPGLPTSAELFILPPKNLTERRKGNEGDLEQIVETLFNALNQNLVQFELKPGVQVIVYVTQLTLAPLVDSSAGHSSSAMLMLLSVVFVGLAVFLIYKFKRKIPWINIYAQVQHDKEQEMIGSVSQSENAPKITLSDFTEPEELLDKELDTRVIGGIATIANSESTKEIPNCTSV

SEQ ID NO: 794045 - protein, 123 aa, Homo sapiens
AHSLAQSRPQMHAGQMCWYPLHPYGQHDPSRNPVELSRELDSSSQNTPRTLVKHQELWGVPPEKSGGHCRASDTALGEIPHGWAAACIWHCGGGRAAMEDGETHLSRLLLGTAFPPASRSRPK

SEQ ID NO: 794046 - protein, 626 aa, Homo sapiens
MCSTLKKCGTYRTEVAECHDHGSTFQGRKKGGSSFRDNFDKRSCHYEHGGYERPPSHCQENDGSVEMRDVHKDQQLRHTPYSIRCERRMKWHSEDEIRITTWRNRKPPERKMSQNTQDGYTRNWFKVTIPYGIKYDKAWLMNSIQSHCSDRFTPVDFHYVRNRACFFVQDASAASALKDVSYKIYDDENQKICIFVNHSTAPYSVKNKLKPGQMEMLKLTMNKRYNVSQQALDLQNLRFDPDLMGRDIDIILNRRNCMAATLKIIERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQYYSIYDSGDRQGLLGAYHDEACFSLAIPFDPKDSAPSSLCKYFEDSRNMKTLKDPYLKGELLRRTKRDIVDSLSALPKTQHDLSSILVDVWCQTERMLCFSVNGVFKEVEGQSQGSVLAFTRTFIATPGSSSSLCIVNDELFVRDASPQETQSAFSIPVSTLSSSSEPSLSQEQQEMVQAFSAQSGMKLEWSQKCLQDNEWNYTRAGQAFTMLQTEGKIPAEAFKQIS

SEQ ID NO: 794047 - protein, 148 aa, Homo sapiens
MILASGARGPGFKSRTSPPLPFTETRVSSRNMLPDQRCRRLDCKSSMYSKLFCGTAVAESISIPRPAWHVRKRRGTPRLGQVPPFLLPDFLPGVSTRPPQPGFALIDTRQSIVVDDSVRESPGTVKTWFSAVLKALCLFRSLHLTIGA

SEQ ID NO: 794048 - protein, 117 aa, Homo sapiens
QGDGGMGHGASWSSLEAGKPQPSVMSTVETQASLIRAGAGSACWHRAGPCTESLGRGMQVKAGRACLEGHWAPPPGWRGAEGWAGGAAGRWSFLKVIQIEGSAQTPRTHRVTPSVHV

SEQ ID NO: 794049 - protein, 157 aa, Homo sapiens
ACGRSSLTRLASHMAEYECFQIELSKNYGMSEWRDDVKKVLLKAGLQNLPITFLFSDTQIKNESFLEDINNVLNSGDIPNLYTADEQDQIVSTMRPYIQEQGLQPTKANLMAAYTGRVRSNIHMVLCMSPIGEVFRARLRQFPSLVNCCTIDWFNEW

SEQ ID NO: 794050 - protein, 127 aa, Homo sapiens
EYLLSLSCPCVTIVHWACGLVFLAHRSLSEEEPPLRSCTQGDSATARPTAHFEIMVLEPDVVIGCFGKGGCILQVGGQSIFRSREQTVVECHINALSQSCLFHTDSGLAIRHVLANRSSANVVQAIS

SEQ ID NO: 794051 - protein, 76 aa, Homo sapiens
MAAVGEETARAAVTAKSSEREKKDQCFTGLWGGSYHQGYKTLQRNPCTSKFVVKGKTLGSWAGFYFLRQSLALLPG

SEQ ID NO: 794052 - protein, 132 aa, Homo sapiens
RFQTLQCTFSSQEKCKLSSGPKNLYMNYPCITSGEASPSTTLPSFFSILIAPFNGPDRIPFSHRPLANAALTAQVIFPGSCLLRIKVTPPESVPNQSELTKSLLHTLKLHEMSFIALIPVIISLHLFTQWLY

SEQ ID NO: 794053 - protein, 510 aa, Homo sapiens
TRPIIKKLEDGGSSKQLAVIYGIGETTVRDIRKNKEKIITYASSSDSTSLLAKRKSMKPSMYEELDRAMLEWFNQQRAKGNPISGPICAKRAEFFFYALGMDGDFNPSAGWLTRFKQRHSIREINIRNERLNGDETAVEDFCNNFRDFIERENLQPEQIYNADETGLFWKCLPSRISVIKGKCTVPGHKSIEERVTIMCCANATGLHKLKLCVVGKAKKPRSFKSTDTLNLPVSYFSQKGAWMDLSIFRQWFDKIFVPQVREYLRSKGLQEKAVLLLDNSPTHPNENVLRSDDGQIFAKYLPPNVASLIQPSDQGVIATMKRNYRAGLLQNNLEEGNDLKSFWKKLTLLDALYEIAMAWNLVKPVTISRAWKKILPMVEEKESLDFDVEDISVATVAAILQHTKGLENVTTENLEKWLEVDSTEPGYEVLTDSEIIRRAQGQADESSENEEEEIELIPEKHINHAAALQWTENLLDYLEQQGDMILPDRLVIRKLRATIRNKQKMTKSSQ

SEQ ID NO: 794054 - protein, 111 aa, Homo sapiens
MWVEVDCFLVACEYALHKRCLLGGKLTGVWLDAVCPALSSWAQHPGTQDIVVEHPNLKLCLSVETQKDGVWVKECGVWLLLSRKRFPLVTDGIGLLVLLKFCCQKINVNRL

SEQ ID NO: 794055 - protein, 154 aa, Homo sapiens
MWVEVDCFLVACEYALHKRCLLGGKLTGVWLDAVCPALSSWAQHPGTQDIVVEHPNLKLCLSVETQKDGVWVKECGVWLLLSRKRFPLVTDGIGLLVLLALFASGLIHRVCVTTCFIFSMVGLYYINKISSTLYQAAAPVLTPAKVTGKSKKRN

SEQ ID NO: 794056 - protein, 112 aa, Homo sapiens
FVTSGRERIILLAISQGVYTPCDIACSICWGEDVIPRNISVRILTGILEVISSGDITPNFTVGVHPVILFVISLGYVTPHVTAGVHPVILFVSFLGGVTPNVQGVFTLGYYW

SEQ ID NO: 794057 - protein, 90 aa, Homo sapiens
DDETLFPSKIGVPFPKNFMSVAKTILNAFFRVYAHIYHQHFDPVIQLQEEAHLNTSFKHFIFFVQEFNLIDRRELAPLQELIEKLTSKDR

SEQ ID NO: 794058 - protein, 96 aa, Homo sapiens
MSGKKRTQAVCCVPTPIPISAPRTRALLRRLQPLHPRGEAEVSRKQCPTVAPQSVQCELRPFPQVWSFLIQLRPPSLYSLSASHPIFCHPTSIFDG

SEQ ID NO: 794059 - protein, 720 aa, Homo sapiens
MVDSLTACTVCLEKLQTLNANPVKGARRGFKPTGVELWPFFPKAMGAHLLHQHDLHVRHGIKGDHFGALRFDCPTGFWACMGPEPLCFDNFLPFGMTVFTQCLYPHCIQEVTNLFLILHAHRQKGFALSHMDFGLWTFELMLNLVKTLGDCWEGMIGFECEDMRFGKGQGQNDTVWLCPHPSLILNSHMLWEGPGGKKLSHGGRSFPCCSHDSEYVSQGVMVLKRVVSLQKLYLLIAAIHVRHDLLLLAFQRDSQASSAMWKCKSIKPLSFVNCPVSVRYVFISSVKTDLIHLCSFFLSLFMVAVWWVSLVVMFESFLLCVSELLVSFILSCIFMMVDIVLLLPNVGLPETFLVGPQQTRHKQTVFCLSGKYFFLFYYYYFFFSNGDLTLPPRLEYSGMIIAHCSLELLGSNGPPASAFLSLWNCRCEPLCQASSFVKDSFAGYSIFGLHFFIFILLVVYIPFSPEPVRFLLRNPLLPDGDSLISDLMPFFAVFSIFSLSFDNFTIMCLGEDLFELYLFGNLLSFLHLEAFRKFSVIILLNRFSMPLPISSPSRTPRISVFGDICVPYVMEPCFILFSFFLSDWIILKDSLQVQKFFVLLDLVYCYKLSIIFCIYFNDLFSSRICVWFFVMLSISVEFVVQILNCFPVWFFFFVFFFLYSLSVFSCISLSFFNNIILNFFQAFHRFSFHWICCWRIIVLLWRCYVSFFIFLASLCDYLCL

SEQ ID NO: 794060 - protein, 354 aa, Homo sapiens
MGSGASAEDKELAKRSKELEKKLQEDADKEAKTVKLLLLGAGESGKSTIVKQMKIIHQDGYSPEECLEFKAIIYGNVLQSILAIIRAMTTLGIDYAEPSCADDGRQLNNLADSIEEGTMPPELVEVIRRLWKDGGVQACFERAAEYQLNDSASYYLNQLERITDPEYLPSEQDVLRSRVKTTGIIETKFSVKDLNFRMFDVGGQRSERKKWIHCFEGVTCIIFCAALSAYDMVLVEDDEVNRMHESLHLFNSICNHKFFAATSIVLFLNKKDLFEEKIKKVHLSICFPEYDGNNSYDDAGNYIKSQFLDLNMRKDVKEIYSHMTCATDTQNVKFVFDAVTDIIIKENLKDCGLF

SEQ ID NO: 794061 - protein, 140 aa, Homo sapiens
MGSGASAEDKELAKRSKELEKKLQEDADKEAKTVKLLLLGAGESGKSTIVKQMKIIHQDGYSPEECLEFKAIIYGNVLQSILAIIRAMTTLGIDYAEPSCADDGRQLNNLADSIEEGTMPPELVEVIRRLWKDGGVQACF

SEQ ID NO: 794062 - protein, 354 aa, Homo sapiens; identical to SEQ ID NO: 794060

SEQ ID NO: 794063 - protein, 354 aa, Homo sapiens; identical to SEQ ID NO: 794060

SEQ ID NO: 794064 - protein, 181 aa, Homo sapiens
MGDIFKNNGVLQGRLRAVACAPHRFGPRLRCLHHDQGLTELAWGTWPHSHPVRHQPQMPSARECCSIVCMAAKEVSAPKAPGSPWMVPGDVAMSGHRVGALDERGHPNPQTGHCRGGSVSVTWSSVSCCRGRLAAVRVMIARDPSTCHLAKGCSPAWGFLPQARGPAGTRTPQRRCSSHEA

SEQ ID NO: 794065 - protein, 93 aa, Homo sapiens
MAKQNWKDAEAWFTSWTEELNQEVTGHIEQLQISRSEVTDLQCTLQGLEIELHSQLSVKAPLEGTLAETEACFGAQLVQIQALISSIEAQLGD

SEQ ID NO: 794066 - protein, 648 aa, Homo sapiens
MSHHGGAPKASTWVVASRRSSTVSRAPERRPAEELNRTGPEGYSVGRGGRWRGTSRPPEAVAAGHEELPLCFALKSHFVGAVIGRGGSKIKNIQSTTNTTIQIIQEQPESLVKIFGSKAMQTKAKAVIDNFVKKLEENYNSECGIDTAFQPSVGKDGSTDNNVVAGDRPLIDWDQIREEGLKWQKTKWADLPPIKKNFYKESTATSAMSKVEADSWRKENFNITWDDLKDGEKRPIPNPTCTFDDAFQCYPEVMENIKKAGFQKPTPIQSQAWPIVLQGIDLIGVAQTGTGKTLCYLMPGFIHLVLQPSLKGQRNRPGMLVLTPTRELALQVEGECCKYSYKGLRSVCVYGGGNRDEQIEELKKGVDIIIATPGRLNDLQMSNFVNLKNITYLVLDEADKMLDMGFEPQIMKILLDVRPDRQTVMTSATWPHSVHRLAQSYLKEPMIVYVGTLDLVAVSSVKQNIIVTTEEEKWSHMQTFLQSMSSTDKVIVFVSRKAVADHLSSDLILGNISVESLHGDREQRDREKALENFKTGKVRILIATDLASRGLDVHDVTHVYNFDFPRNIEEYVHRIGRTGRAGRTGVSITTLTRNDWRVASELINILERANQSIPEELVSMAERFEAHQRKREMERKMERPQGRPKKFH

SEQ ID NO: 794067 - protein, 59 aa, Homo sapiens
MGRPRNMGSCPSECCTGSCSHLFLPGDHSMRVKFFPFQEPKCLFVYPILVSNRAKWTSM

SEQ ID NO: 794068 - protein, 754 aa, Homo sapiens
QSVSGRRSRESGSRSSPWPQAGRLEGEELPPFFGIRTHHDGCDLRPSGSPGVMAQKHPGERGLYGAHHSGGASLRTLGPSVDPEIPSFSGLRDSAGTAPNGTRCLTEHSGPKHTQHPNPAHWLDPSHGPPGGPGPPRDAEDPDQSETSSEEESGVDQELSKENETGNQKDGNSFLSIPSACNCQGTPGIPEGPYSEGGNGSSSNFCHHCTSPALGEDELEEEYDDEESLKFPSDFSRVSSGKKPPSRRQRHRFPTKEDTREGGRRDPRSPGRHRLGRKRSQADKRKGLGLWGAEELCQLGQAGFWWLIELLVLVGEYVETCGHLIYACRQLKSSDLDLFRVWMGVWTGRLGGWAQVMFQFLSQGFYCGVGLFTRFLKLLGALLLLALALFLGFLQLGWRFLVGLGDRLGWRDKATWLFSWLDSPALQRCLTLLRDSRPWQRLVRIVQWGWLELPWVKQNINRQGNAPVASGRYCQPEEEVARLLTMAGVPEDELNPFHVLGVEATASDVELKKAYRQLAVMVHPDKNHHPRAEEAFKVLRAAWDIVSNAEKRKEYEMKRMAENELSRSVNEFLSKLQDDLKEAMNTMMCSRCQGKHRRFEMDREPKSARYCAECNRLHPAEEGDFWAESSMLGLKITYFALMDGKVYDITEWAGCQRVGISPDTHRVPYHISFGSRIPGTRGRQRATPDAPPADLQDFLSRIFQVPPGQMPNGNFFAAPQPAPGAAAASKPNSTVPKGEAKPKRRKKVRRPFQR

SEQ ID NO: 794069 - protein, 702 aa, Homo sapiens
MAQKHPGERGLYGAHHSGGASLRTLGPSVDPEIPSFSGLRDSAGTAPNGTRCLTEHSGPKHTQHPNPAHWLDPSHGPPGGPGPPRDAEDPDQSETSSEEESGVDQELSKENETGNQKDGNSFLSIPSACNCQGTPGIPEGPYSEGGNGSSSNFCHHCTSPALGEDELEEEYDDEESLKFPSDFSRVSSGKKPPSRRQRHRFPTKEDTREGGRRDPRSPGRHRLGRKRSQADKRKGLGLWGAEELCQLGQAGFWWLIELLVLVGEYVETCGHLIYACRQLKSSDLDLFRVWMGVWTGRLGGWAQVMFQFLSQGFYCGVGLFTRFLKLLGALLLLALALFLGFLQLGWRFLVGLGDRLGWRDKATWLFSWLDSPALQRCLTLLRDSRPWQRLVRIVQWGWLELPWVKQNINRQGNAPVASGRYCQPEEEVARLLTMAGVPEDELNPFHVLGVEATASDVELKKAYRQLAVMVHPDKNHHPRAEEAFKVLRAAWDIVSNAEKRKEYEMKRMAENELSRSVNEFLSKLQDDLKEAMNTMMCSRCQGKHRRFEMDREPKSARYCAECNRLHPAEEGDFWAESSMLGLKITYFALMDGKVYDITEWAGCQRVGISPDTHRVPYHISFGSRIPGTRGRQRATPDAPPADLQDFLSRIFQVPPGQMPNGNFFAAPQPAPGAAAASKPNSTVPKGEAKPKRRKKVRRPFQR

SEQ ID NO: 794070 - protein, 154 aa, Homo sapiens [sequence omitted]

SEQ ID NO: 794071 - protein, 120 aa, Homo sapiens
GFPILFGLFPPSVHCEFFCLFLWLRMVFHPEPLVFFSFYFSYVPLALPPPPGLVLAVVFAALFFPLFVSPSLSTGCLVLLVISTTSLQPSSSCRHLLLSVRLCGMAHPRHYDFLISDPSL

SEQ ID NO: 794072 - protein, 357 aa, Homo sapiens
QSVSGRRSRESGSRSSPWPQAGRLEGEELPPFFGIRTHHDGCDLRPSGSPGVMAQKHPGERGLYGAHHSGGASLRTLGPSVDPEIPSFSGLRDSAGTAPNGTRCLTEHSGPKHTQHPNPAHWLDPSHGPPGGPGPPRDAEDPDQSETSSEEESGVDQELSKENETGNQKDGNSFLSIPSACNCQGTPGIPEGPYSEGGNGSSSNFCHHCTSPALGEDELEEEYDDEESLKFPSDFSRVSSGKKPPSRRQRHRFPTKEDTREGGRRDPRSPGRHRLGRKRSQADKRKGLGLWGAEELCQLGQAGFWWLIELLVLVGEYVETCGHLIYACRQLKSSDLDLFRVWMGIPVGIRDPLDHLG

SEQ ID NO: 794073 - protein, 754 aa, Homo sapiens; identical to SEQ ID NO: 794068

SEQ ID NO: 794074 - protein, 754 aa, Homo sapiens; identical to SEQ ID NO: 794068

SEQ ID NO: 794075 - protein, 124 aa, Homo sapiens
MSILKITYFALMDGKVYDITEWAGCQRVGISPDTHRVPYHISFGSRIPGTRGRQRATPDAPPADLQDFLSRIFQVPPGQMPNGNFFAAPQPAPGAAAASKPNSTVPKGEAKPKRRKKVRRPFQR

SEQ ID NO: 794076 - protein, 390 aa, Homo sapiens
MPDTNSTINLSLSTRVTLAFFMSLVAFAIMLGNALVILAFVVDKNLRHRSSYFFLNLAISDFFVGVISIPLYIPHTLFEWDFGKEICVFWLTTDYLLCTASVYNIVLISYDRYLSVSNAVSYRTQHTGVLKIVTLMVAVWVLAFLVNGPMILVSESWKDEGSECEPGFFSEWYILAITSFLEFVIPVILVAYFNMNIYWSLWKRDHLSRCQSHPGLTAVSSNICGHSFRGRLSSRRSLSASTEVPASFHSERQRRKSSLMFSSRTKMNSNTIASKMGSFSQSDSVALHQREHVELLRARRLAKSLAILLGVFAVCWAPYSLFTIVLSFYSSATGPKSVWYRIAFWLQWFNSFVNPLLYPLCHKRFQKAFLKIFCIKKQPLPSQHSRSVSS

SEQ ID NO: 794077 - protein, 965 aa, Homo sapiens
VEYMRLGENIIEYSRDFKLYITTRLRNPHYLPEVAVKVCLLNFMITPLGLQDQLLGIVAAKEKPELEEKKNQLIVESAKNKKHLKEIEDKILEVLSMSKGNILEDETAIKVLSSSKVLSEEISEKQKVASMTETQIDETRMGYKPVAVHSATIFFCISDLANIEPMYQYSLTWFINLYMHSLTHSTKSEELNLRIKYIIDHFTLSIYNNVCRSLFEKDKLLFSLLLTIGIMKQKKEITEEVWYFLLTGGIALDNPYPNPAPQWLSEKAWAEIVRASALPKLHGLMEHLEQNLGEWKLIYDSAWPHEEQLPGSWKFSQGLEKMVILRCLRPDKMVPAVREFIAEHMGKLYIEAPTFDLQGSYNDSSCCAPLIFVLSPSADPMAGLLKFADDLGMGGTRTQTISLGQGQGPIAAKMINNAIKDGTWVVLQNCHLAASWMPTLEKICEEVIVPESTNARFRLWLTSYPSEKFPVSILQNGIKMTNEPPKGLRANLLRSYLNDPISDPVFFQSCAKAVMWQKMLFGLCFFHAVVQERRNFGPLGWNIPYEFNESDLRISMWQIQMFLNDYKEVPFDALTYLTGECNYGGRVTDDKDRRLLLSLLSMFYCKEIEEDYYSLAPGDTYYIPPHGSYQSYIDYLRNLPITAHPEVFGLHENADITKDNQETNQLFEGVLLTLPRQSGGSGKSPQEVVEELAQDILSKLPRDFDLEEVMKLYPVVYEESMNTVLRQELIRFNRLTKVVRRSLINLGRAIKGQVLMSSELEEVFNSMLVGKVPAMWAAKSYPSLKPLGGYVADLLARLTFFQEWIDKGPPVVFWISGFYFTQSFLTGVSQNYARKYTIPIDHIGFEFEVTPQETVMENNPEDGAYIKGLFLEGARWDRKTMQIGESLPKILYDPLPIIWLKPGESAMFLHQDIYVCPVYKTSARRGTLSTTGHSTNYVLSIELPTDMPQKHWINRGVASLCQLDN

SEQ ID NO: 794078 - protein, 126 aa, Homo sapiens
GAHSFLFFQVTPQETVMENNPEDGAYIKGLFLEGARWDRKTMQIGESLPKILYDPLPIIWLKPGESAMFLHQDIYVCPVYKTSARRGTLSTTGHSTNYVLSIELPTDMPQKHWINRGVASLCQLDN

SEQ ID NO: 794079 - protein, 104 aa, Homo sapiens
VAQPEMSGLMLVLGVDWDKVRLIGPSSGSLLSSSTHVSMTVIQRNRGERVWREVSRGKKEGREEGSRLLTNHTIRALLVPSSWEATVISNSKTNQGYLSHFASL

SEQ ID NO: 794080 - protein, 248 aa, Homo sapiens
MGLSIFLLLCVLGLSQAATPKIFNGTECGRNSQPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICKYVDWIRMIMRNN

SEQ ID NO: 794081 - protein, 226 aa, Homo sapiens
MQGSKPWQVGLFEGTSLRCGGVLIDHRWVLTAAHCSGSRYWVRLGEHSLSQLDWTEQIRHSGFSVTHPGYLGASTSHEHDLRLLRLRLPVRVTSSVQPLPLPNDCATAGTECHVSGWGITNHPRNPFPDLLQCLNLSIVSHATCHGVYPGRITSNMVCAGGVPGQDACQGDSGGPLVCGGVLQGLVSWGSVGPCGQDGIPGVYTYICNSTLVGLGTSWNFNSCQPF

SEQ ID NO: 794082 - protein, 119 aa, Homo sapiens
PKKNWIAIYELLFKEGVMVAKKDVHMPKHPELADKNVPNLHVMKAMQSLKSRGYVKEQFAWRHFYWYLTNEGIQYLRDYLHLPPEIVPATLRRSRPETGSLGLKVWRVSDLRDSQEGKL

SEQ ID NO: 794083 - protein, 221 aa, Homo sapiens
MAAVGPRTGPGTGAEALALAAELQGEATCSICLELFREPVSVECGHSFCRACIGRCWERPGAGSVGAATRAPPFPLPCPQCREPARPSQLRPNRQLAAVATLLRRFSLPAAAPGEHGSQAAAARAAAARCGQHGEPFKLYCQDDGRAICVVCDRAREHREHAVLPLDEAVQEAKELLESRLRVLKKELEDCEVFRSTEKKESKELLVSQAPAGPPWDITEA

SEQ ID NO: 794084 - protein, 511 aa, Homo sapiens
MAAVGPRTGPGTGAEALALAAELQGEATCSICLELFREPVSVECGHSFCRACIGRCWERPGAGSVGAATRAPPFPLPCPQCREPARPSQLRPNRQLAAVATLLRRFSLPAAAPGEHGSQAAAARAAAARCGQHGEPFKLYCQDDGRAICVVCDRAREHREHAVLPLDEAVQEAKELLESRLRVLKKELEDCEVFRSTEKKESKELLKQMAAEQEKVGAEFQALRAFLVEQEGRLLGRLEELSREVAQKQNENLAQLGVEITQLSKLSSQIQETAQKPDLDFLQEFKSTLSRCSNVPGPKPTTVSSEMKNKVWNVSLKTFVLKGMLKKFKEDLRGELEKEEKVELTLDPDTANPRLILSLDLKGVRLGERAQDLPNHPCRFDTNTRVLASCGFSSGRHHWEVEVGSKDGWAFGVARESVRRKGLTPFTPEEGVWALQLNGGQYWAVTSPERSPLSCGHLSRVRVALDLEVGAVSFYAVEDMRHLYTFRVNFQERVFPLFSVCSTGTYLRIWP

SEQ ID NO: 794085 - protein, 329 aa, Homo sapiens
MTQATGQMLCLHVQVPLQLLLLGQKQMAAEQEKVGAEFQALRAFLVEQEGRLLGRLEELSREVAQKQNENLAQLGVEITQLSKLSSQIQETAQKPDLDFLQEFKSTLSRCSNVPGPKPTTVSSEMKNKVWNVSLKTFVLKGMLKKFKEDLRGELEKEEKVELTLDPDTANPRLILSLDLKGVRLGERAQDLPNHPCRFDTNTRVLASCGFSSGRHHWEVEVGSKDGWAFGVARESVRRKGLTPFTPEEGVWALQLNGGQYWAVTSPERSPLSCGHLSRVRVALDLEVGAVSFYAVEDMRHLYTFRVNFQERVFPLFSVCSTGTYLRIWP

SEQ ID NO: 794086 - protein, 303 aa, Homo sapiens
MAAEQEKVGAEFQALRAFLVEQEGRLLGRLEELSREVAQKQNENLAQLGVEITQLSKLSSQIQETAQKPDLDFLQEFKSTLSRCSNVPGPKPTTVSSEMKNKVWNVSLKTFVLKGMLKKFKEDLRGELEKEEKVELTLDPDTANPRLILSLDLKGVRLGERAQDLPNHPCRFDTNTRVLASCGFSSGRHHWEVEVGSKDGWAFGVARESVRRKGLTPFTPEEGVWALQLNGGQYWAVTSPERSPLSCGHLSRVRVALDLEVGAVSFYAVEDMRHLYTFRVNFQERVFPLFSVCSTGTYLRIWP

SEQ ID NO: 794087 - protein, 369 aa, Homo sapiens
MLLGKQDPETFRVTSQCNLVACRDDFYPASPSELLESRLRVLKKELEDCEVFRSTEKKESKELLKQMAAEQEKVGAEFQALRAFLVEQEGRLLGRLEELSREVAQKQNENLAQLGVEITQLSKLSSQIQETAQKPDLDFLQEFKSTLSRCSNVPGPKPTTVSSEMKNKVWNVSLKTFVLKGMLKKFKEDLRGELEKEEKVELTLDPDTANPRLILSLDLKGVRLGERAQDLPNHPCRFDTNTRVLASCGFSSGRHHWEVEVGSKDGWAFGVARESVRRKGLTPFTPEEGVWALQLNGGQYWAVTSPERSPLSCGHLSRVRVALDLEVGAVSFYAVEDMRHLYTFRVNFQERVFPLFSVCSTGTYLRIWP

SEQ ID NO: 794088 - protein, 303 aa, Homo sapiens; identical to SEQ ID NO: 794086

SEQ ID NO: 794089 - protein, 104 aa, Homo sapiens
MEHPVTSHTEYPVTHHTEHPITRHTEHPVTHHTEHPVTRSCPCPFVASSPPGSSLLEFHVHESQRVFSLLWNSFTQHNVCVTHPPAASVGAGLPSILLSSPFFR

SEQ ID NO: 794090 - protein, 115 aa, Homo sapiens
MLIVHYVPDTVLSIGKTALSLVEESPASMVFKAQWEIDASFEGGRGYYLSLALTELGVTPCALSFLSYRILTSTLRSKMKIHFVDEETEAAERLGDFAKAAESLNGKQEFRYRAL

SEQ ID NO: 794091 - protein, 1283 aa, Homo sapiens
GQGSSPTLPFVNSPSSSLTLKPSCITMASCSFTRDQATRRLRGAAAAAAAALAAVVTTPLLSSGTPTALIGTGSSCPGAMWLSTATGSRSDSESEEEDLPVGEEVCKRGYLRKQKHGHRRYFVLKLETADAPARLEYYENARKFRHSVRAAAAAAAAAASGAAIPPLIPPRRVITLYQCFSVSQRADARYRHLIALFTQDEYFAMVAENESEQESWYLLLSRLILESKRRRCGTLGAQPDGEPAALAAAAAAEPPFYKDVWQVIVKPRGLGHRKELSGVFRLCLTDEEVVFVRLNTEVASVVVQLLSIRRCGHSEQYFFLEVGRSTVIGPGELWMQVDDCVVAQNMHELFLEKMRALCADEYRARCRSYSISIGAHLLTLLSARRHLGLVPLEPGGWLRRSRFEQFCHLRAIGDGEDEMLFTRRFVTPSEPVAHSRRGRLHLPRGRRSRRAVSVPASFFRRLAPSPARPRHPAEAPNNGARLSSEVSGSGSGNFGEEGNPQGKEDQEGSGGDYMPMNNWGSGNGRGSGGGQGSNGQGSSSHSSGGNQCSGEGQGSRGGQGSNGQGSGGNQCSRDGQGTAGGHGSGGGQRPGGGHGSGGGQGPGDGHGSGGGKNSGGGKGSGSGKGSDGDGERGKSLKKRSYFGKLTQSKQQQMPPPPPPPPPPPPAGGTGGKGKSGGRFRLYFCVDRGATKECKEAKEVKDAEIPEGAARGPHRARAFDEDEDDPYVPMRPGVATPLVSSSDYMPMAPQNVSASKKRHSRSPFEDSRGYMMMFPRVSPPPAPSPPKAPDTNKEDDSKDNDSESDYMFMAPGAGAIPKNPRNPQGGSSSKSWSSYFSLPNPFRSSPLGQNDNSEYVPMLPGKFLGRGLDKEVSYNWDPKDAASKPSGEGSFSKPGDGGSPSKPSDHEPPKNKAKRPNRLSFITKGYKIKPKPQKPTHEQREADSSSDYVNMDFTKRESNTPAPSTQGLPDSWGIIAEPRQSAFSNYVNVEFGVPFPNPANDLSDLLRAIPRANPLSLDSARWPLPPLPLSATGSNAIEEEGDYIEVIFNSAMTPAMALADSAIRYDAETGRIYVVDPFSECCMDISLSPSRCSEPPPVARLLQEEEQERRRPQSRSQSFFAAARAAVSAFPTDSLERDLSPSSAPAVASAAEPTLALSQVVAAASALAAAPGIGAAAAAAGFDSASARWFQPVANAADAEAVRGAQDVAGGSNPGAHNPSANLARGDNQAGGAAAAAAAPEPPPRSRRVPRPPEREDSDNDDDTHVRMDFARRDNQFDSPKRGR

SEQ ID NO: 794092 - protein, 180 aa, Homo sapiens
MRTRVCVERENGIKRMRARVCGERERNQANENTSVCGERERNQANENTSVCGERERNQANESACVWRENGIKRMRTRVCVERENGIRRMRTRVCVERENGIKRMTARELCVEGENGIKRMRTRVCVEGENGIKRMRTRVCVEGENGIKRMRARECVWRERERNQANESVSVCGERTESSE

SEQ ID NO: 794093 - protein, 180 aa, Homo sapiens; identical to SEQ ID NO: 794092

SEQ ID NO: 794094 - protein, 133 aa, Homo sapiens
MRTRVCVERENGIKRMRARVCGERERNQANENTSVCGERERNQANENTSVCGERERNQANESACVWRENGIKRMRTRVCVERENGIRRMRTRVCVERENGIKRMTARELCGENGIKRMRARECVWRERTESSE

SEQ ID NO: 794095 - protein, 109 aa, Homo sapiens
EFWISLGHESETKKRRRNGALSIKESEAEAMVWKRLRDFLGTELYTLELLHCCHRKPRFPTPTARASIPTTLSVSTPVSWSVTPGWSAVMQSQLTVTCPPLEDPNSSNL

SEQ ID NO: 794096 - protein, 109 aa, Homo sapiens [sequence omitted]

SEQ ID NO: 794097 - protein, 179 aa, Homo sapiens [sequence omitted]

SEQ ID NO: 794098 - protein, 148 aa, Homo sapiens
FDFITAAWLIFLFMVLCGSSLALLVRILCGSRGLPLTRLYLTILLTVLVFLLCGLPFGIQWFLILWIWKDSDVLFCHIHPVSVVLSSLNSSANPIIYFFVGSFRKQWRLQQPILKLALQRALQDIAEVDHSEGCFRQGTPEMSRSSLV

SEQ ID NO: 794099 - protein, 137 aa, Homo sapiens
GTQPVLSGTGEETVRLGFPVDPRKVLIVAGHHNWIVAAYAHFAVCYRIKESSGWQQVFTSPYLDWTIERVALLARARRTESFHSYRDFQTINLNRNVERAVPENGNLGPIQAEVKGATGECNISERKSPGVEIKSLR

SEQ ID NO: 794100 - protein, 210 aa, Homo sapiens
QLPQRLLPGALRAGIEAVLLSLHPGFRVGFNSLGGLASVNHLHLHGYYLAHRLPVEQAPSEPLDPGGHLHLLQDLPAPGFLFYTRGPGPDLESLISRVCRATDYLTDHEIAHNLFVTRGAPPGKTSPSSALTGVRVILWARKSSFGIKDGEAFNVALCELAGHLPVKTSQDFSSLTEAAAVALIQDCRLPPSQAEDVQAALVALMSQEEQ

SEQ ID NO: 794101 - protein, 148 aa, Homo sapiens
TGCAVYVWCLISCLGTSGHPCPLSPGQLGELCPEGCLSPTAGVDAGLVWVGGHRAPEAHPGLLLLAQGSSTEPPQAQLHRYNGLFRPSSCLPAFSPGPELSEVNLTRSSSCFFAASPGPAPASWWPLQAQPLPPVGLYSPNICLIADS

SEQ ID NO: 794102 - protein, 163 aa, Homo sapiens
MESSRAGCVLWPVLLTALDPGCAVSTTTKDSQSSPGGPGPTVTPSVISLKCHQPVNAAPSSAWQPRRMVPGDVAMSGHRVGALDERGHPNPQTGHCRGGSVSVTWSSVSCCRGRLAAVRVMIARDPSTCHLAKGCSPAWGFLPQARGPAGTRTPQRRCSSHEA

SEQ ID NO: 794103 - protein, 135 aa, Homo sapiens [sequence omitted]

SEQ ID NO: 794104 - protein, 1000 aa, Homo sapiens
MHPCGHLPSPCSDAVLAVEWECDEATKKACYSKGKSKEECQNYIRVLLVGGDRLFTCGTNAFTPVCTNRSLSNLAEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVCKNDIGGRFLLEDTWTTFMKARLNCSRPGEVPFYYNELQSTFFLPELDLIYGIFTTNVNSIAASAVCVFNLSAIAQAFSGPFKYQENSRSAWLPYPNPNPHFQCGTVDQGLYVNLTERNLQDAQKFILVHEVVQPVTTVPSFMEDNSRFSHVAVDVVQGREALVHIIYLATDYGTIKKVRVPLNQTSSSCLLEEIELFPERRREPIRSLQILHSQSVLFVGLREHVVKIPLKRCQFYRTRSTCIGAQDPYCGWDVVMKKCTSLEESLSMTQWEQSISACPTRNLTVDGHFGVWSPWTPCTHTDGSAVGSCLCRTRSCDSPAPQCGGWQCEGPGMEIANCSRNGGWTPWTSWSPCSTTCGIGFQVRQRSCSNPTPRHGGRVCVGQNREERYCNEHLLCPPHMFWTGWGPWERCTAQCGGGIQARRRICENGPDCAGCNVEYQSCNTNPCPELKKTTPWTPWTPVNISDNGDHYEQRFRYTCKARLADPNLLEVGRQRIEMRYCSSDGTSGCSTDGLSGDFLRAGRYSAHTVNGAWSAWTSWSQCSRDCSRGIRNRKRVCNNPEPKYGGMPCLGPSLEYQECNTLPCPVDGVWSCWSPWTKCSATCGGGHYMRTRSCSNPAPAYGGDICLGLHTEEALCNTQPCPESWSEWSDWSECEASGVQVRARQCILLFPMGSQCSGNTTESRPCVFDSNFIPEVSVARSSSVEEKRCGEFNMFHMIAVGLSSSILGCLLTLLVYTYCQRYQQQSHDATVIHPVSPAPLNTSITNHINKLDKYDSVEAIKAFNKNNLILEERNKYFNPHLTGKTYSNAYFTDLNNYDEY

SEQ ID NO: 794105 - protein, 157 aa, Homo sapiens
ALPEPAPERCFPAAGGLRSLRPAAALGPLQPRPSTFPVQGRPGQCRSSRDAPFSHPGLPRGAGLDTQLCHLEGRLCWARTCPPTGWPRARGPCSWPPSRCPHSGTQRVGGGSGEVAGGGCSCCLHFPSQVLKRILGAALAPRRWMTGTSAPRTCVGV

SEQ ID NO: 794106 - protein, 1074 aa, Homo sapiens
MKGTCVIAWLFSSLGLWRLAHPEAQGTTQCQRTEHPVISYKEIGPWLREFRAKNAVDFSQLTFDPGQKELVVGARNYLFRLQLEDLSLIQAVEWECDEATKKACYSKGKSKEECQNYIRVLLVGGDRLFTCGTNAFTPVCTNRSLSNLAEIHDQISGMARCPYSPQHNSTALLTAGGELYAATAMDFPGRDPAIYRSLGILPPLRTAQYNSKWLNEPNFVSSYDIGNFTYFFFRENAVEHDCGKTVFSRAARVCKNDIGGRFLLEDTWTTFMKARLNCSRPGEVPFYYNELQSTFFLPELDLIYGIFTTNVNSIAASAVCVFNLSAIAQAFSGPFKYQENSRSAWLPYPNPNPHFQCGTVDQGLYVNLTERNLQDAQKFILVHEVVQPVTTVPSFMEDNSRFSHVAVDVVQGREALVHIIYLATDYGTIKKVRVPLNQTSSSCLLEEIELFPERRREPIRSLQILHSQSVLFVGLREHVVKIPLKRCQFYRTRSTCIGAQDPYCGWDVVMKKCTSLEESLSMTQWEQSISACPTRNLTVDGHFGVWSPWTPCTHTDGSAVGSCLCRTRSCDSPAPQCGGWQCEGPGMEIANCSRNGGWTPWTSWSPCSTTCGIGFQVRQRSCSNPTPRHGGRVCVGQNREERYCNEHLLCPPHMFWTGWGPWERCTAQCGGGIQARRRICENGPDCAGCNVEYQSCNTNPCPELKKTTPWTPWTPVNISDNGDHYEQRFRYTCKARLADPNLLEVGRQRIEMRYCSSDGTSGCSTDGLSGDFLRAGRYSAHTVNGAWSAWTSWSQCSRDCSRGIRNRKRVCNNPEPKYGGMPCLGPSLEYQECNTLPCPVDGVWSCWSPWTKCSATCGGGHYMRTRSCSNPAPAYGGDICLGLHTEEALCNTQPCPESWSEWSDWSECEASGVQVRARQCILLFPMGSQCSGNTTESRPCVFDSNFIPEVSVARSSSVEEKRCGEFNMFHMIAVGLSSSILGCLLTLLVYTYCQRYQQQSHDATVIHPVSPAPLNTSITNHINKLDKYDSVEAIKAFNKNNLILEERNKYFNPHLTGKTYSNAYFTDLNNYDEY

SEQ ID NO: 794107 - protein, 88 aa, Homo sapiens
TGLPRRSGSVSLQPLNREDLRKSQSESLGPEFQGLWEWLPENRKKGRIKERRKERRKEGRKEEQKEGMKDKNKDKERENEKVIQEFKM

SEQ ID NO: 794108 - protein, 92 aa, Homo sapiens
SEGRPGRGRAPGPGPPSLGELRLHGGQAQAGRDQVRELAHGAGAEAGAACAAAGESELAARRLVQRQRQMKRKLSHRMKRKLKHKMTACFWP

SEQ ID NO: 794109 - protein, 119 aa, Homo sapiens
KWQMLIKPSDLMRTYYHENSMGETAPMIQLPPPGSFLNTWGLWGLQFKMRFGQGSESLTISDGKDMRVDKICIGYNVHCLSDGSTRSPNFTIMQCTIYTQCNKPVHVPLQSEIKVVFFF

SEQ ID NO: 794110 - protein, 66 aa, Homo sapiens
PSGDTGRRDSSGHRAASSGQHPATHRHRIKALKNDHRQPPVHRQDDTVSSSVGLAGPLPITVRHST

SEQ ID NO: 794111 - protein, 889 aa, Homo sapiens
YFILIKQVYAATRTMESTLTLATEQPVKKNTLKKYKIACIVLLALLVIMSLGLGLGLGLRKLEKQGSCRKKCFDASFRGLENCRCDVACKDRGDCCWDFEDTCVESTRIWMCNKFRCGETRLEASLCSCSDDCLQKKDCCADYKSVCQGETSWLEENCDTAQQSQCPEGFDLPPVILFSMDGFRAEYLYTWDTLMPNINKLKTCGIHSKYMRAMYPTKTFPNHYTIVTGLYPESHGIIDNNMYDVNLNKNFSLSSKEQNNPAWWHGQPMWLTAMYQGLKAATYFWPGSEVAINGSFPSIYMPYNGSVPFEERISTLLKWLDLPKAERPRFYTMYFEEPDSSGHAGGPVSARVIKALQVVDHAFGMLMEGLKQRNLHNCVNIILLADHGMDQTYCNKMEYMTDYFPRINFFYMYEGPAPRIRAHNIPHDFFSFNSEEIVRNLSCRKPDQHFKPYLTPDLPKRLHYAKNVRIDKVHLFVDQQWLAVRSKSNTNCGGGNHGYNNEFRSMEAIFLAHGPSFKEKTEVEPFENIEVYNLMCDLLRIQPAPNNGTHGSLNHLLKVPFYEPSHAEEVSKFSVCGFANPLPTESLDCFCPHLQNSTQLEQVNQMLNLTQEEITATVKVNLPFGRPRVLQKNVDHCLLYHREYVSGFGKAMRMPMWSSYTVPQLGDTSPLPPTVPDCLRADVRVPPSESQKCSFYLADKNITHGFLYPPASNRTSDSQYDALITSNLVPMYEEFRKMWDYFHSVLLIKHATERNGVNVVSGPIFDYNYDGHFDAPDEITKHLANTDVPIPTHYFVVLTSCKNKSHTPENCPGWLDVLPFIIPHRPTNVESCPEGKPEALWVEERFTAHIARVRDVELLTGLDFYQDKVQPVSEILQLKTYLPTFETTI

SEQ ID NO: 794112 - protein, 75 aa, Homo sapiens
LHPSSKHKALQEGPVVPTLDYTTKEMKTQPTEAWPLWGFPSPAPSARQGTCIVGPSFHVNGNPGPWQKYSCFGCI

SEQ ID NO: 794113 - protein, 77 aa, Homo sapiens
DRLSPGVLGCSALCRSGVRTKFGINMVTSRERGTTRFLGLPKCWDHRREPPRPAFILFLVQMGFHHLGQAGLELLTS

SEQ ID NO: 794114 - protein, 108 aa, Homo sapiens
MGSSSEASFRSAQASCSGARRQGLGRGDQNLSVMPPNGRAQTHTPGWVSPCSENRDGLLPATAPGRLCSHRGADIPSFQTHQDPVTASGSSELHADCPQFRALDRAGN

SEQ ID NO: 794115 - protein, 108 aa, Homo sapiens; identical to SEQ ID NO: 794114

SEQ ID NO: 794116 - protein, 40 aa, Homo sapiens
MARSDTTLSIFNPLSPLYSPLYCPSFLIHTPDPNSSTEFV

SEQ ID NO: 794117 - protein, 199 aa, Homo sapiens
MLFLPHVPQVSARKRRELGTPATLFLGSVDGKRPNTLASNTQLYKWISQNDLLGHPKTKSFMTHGETSGIYEAIYHGIPMVGIPLFADQPDNIAHMKALNVDIRTMSSTDLLNALKTVINDPVYKENAMKLSIIRHDLPIKPLDQAAFWIEFVMQHKGAKHLRVAAHDLTWFQYHNLHVIRFLLAYVSTVIFIITRCCL

SEQ ID NO: 794118 - protein, 158 aa, Homo sapiens
YAIPHILKGGREKNGLGATPGWGRGSGQCIPFPRHSVCSCSCQPPLEMQTCLTSPLENMPGRRQPLEARSLVKLASGWLQMERTWFLAPRKNLSQLIIYLLRQRGSKQTWIHAGLVPACSLQLSPGTRPLSSRFWNSAATDAINIYGASTMCQTLAPD

SEQ ID NO: 794119 - protein, 690 aa, Homo sapiens
KRRLGSGRSAGPPRAPGARGEWERARQDHAGALLRLALGRRAAREQPAARLPRPRQPPGSPQPPVRSSPSAARAGRRPGRARGGGGGGTAPSAPSRLRPLAAGAGRAGAPRRRLEQRPRPRRGLAPGRSPREAARAAEGTERRRGTLPGGGAAAAAAAAAAQGAEAGGAPSQDAAVPAPDLWPPLHAALRAGRGGARGRRAGGRARWGPRGGPAAAASSSALPAAPGGSVFPAGGGPLLTGGAAVHISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVRPSFQDDRSHWKASASGDDSHFDYVHDQNQKNLGGMQSMMYRDKLMTAL

SEQ ID NO: 794120 - protein, 1099 aa, Homo sapiens
KRRLGSGRSAGPPRAPGARGEWERARQDHAGALLRLALGRRAAREQPAARLPRPRQPPGSPQPPVRSSPSAARAGRRPGRARGGGGGGTAPSAPSRLRPLAAGAGRAGAPRRRLEQRPRPRRGLAPGRSPREAARAAEGTERRRGTLPGGGAAAAAAAAAAQGAEAGGAPSQDAAVPAPDLWPPLHAALRAGRGGARGRRAGGRARWGPRGGPAAAASSSALPAAPGGSVFPAGGGPLLTGGAAVHISAAGAAKATLYCRVFLLDGTEVSVDLPKHAKGQDLFDQIVYHLDLVETDYFGLQFLDSAQVAHWLDHAKPIKKQMKIGPAYALHFRVKYYSSEPNNLREEFTRYLFVLQLRHDILSGKLKCPYETAVELAALCLQAELGECELPEHTPELVSEFRFIPNQTEAMEFDIFQRWKECRGKSPAQAELSYLNKAKWLEMYGVDMHVVRGRDGCEYSLGLTPTGILIFEGANKIGLFFWPKITKMDFKKSKLTLVVVEDDDQGREQEHTFVFRLDSARTCKHLWKCAVEHHAFFRLRTPGNSKSNRSDFIRLGSRFRFSGRTEYQATHGSRLRRTSTFERKPSKRYPSRRHSTFKASNPVIAAQLCSKTNPEVHNYQPQYHPNIHPSQPRWHPHSPNVSYPLPSPVLSSSDRLPFGIEENGGTPFLTAASGRHHHQHQHQHQHQHHSNYSLSLTLENKEGPLRSPNSSSKSLTKLSPGTPALFSEAAAHLKKLELETVKAAGPWPPLHININKAEEKKVSEKTLQTPLLPSPVADHVKCNILKAQLENASRVNIQGGKEESPFVNINKKSSLQDASVRSPIPIRVETAQPAVEKPEIKPPRVRKLTRQYSFDEDDLPPDLAEAVGVTTSTTTNTTTAATQVSVPLPSPKVQNVSSPHKSEGKGLLSPGAKSPSDRGGAFTLEPGDLLMDFTEATPLAEPASNPHCAHSRCSPPLSLPMKEETTGVCMYPPIKTRLIKTFPVDTMTPFPDTFTTGPQFTADFRDSKLQCCPGPTSPLIPAATLRPLTETVSTVQTIYTTPETCFSGSQCRDTPAGTGEREDDEKTVDDQTVKFSPCHLEDGMVPSVHLLSSGFVCSL

SEQ ID NO: 794121 - protein, 243 aa, Homo sapiens
SFSPLLETIEPVNILDVKDDCGLQLRVSEDTCPLNVHSYDPQGEGRVDPDLSKPKNLAPLQESQESYTTGTPKATSSHQGLGSTLPRRGTRNAIVPRETSVSKTHRSADRAKGKEKKKKEAEEEDEELSNFAYLLASKLSLSPREHPLSPHHASGGQGSQRASHLLPAGAKGPSKLPYPVAKSGKRALAGGPAPTEKTPHSGAQLGVPREKPLALGVVRPSQPRKRRCDSFVTGRRKKRRRSQ

SEQ ID NO: 794122 - protein, 205 aa, Homo sapiens
SFSPLLETIEPVNILDVKDDCGLQLRVSEDTCPLNVHSYDPQGEGRVDPDLSKPKNLAPLQESQESYTTGTPKATSSHQGLGSTLPRRGTRNAIVPRETSVSKTHRSADRAKGKEKKKKEAEEEDEELSNFAYLLASKLSLSPREHPLSPHHASGGQGSQRASHLLPAGAKGPSKLPYPVAKSGKRALAGGPAPTSGSSSTLTAS

SEQ ID NO: 794123 - protein, 110 aa, Homo sapiens
NAGCTVWEGSPTEPAAEIAAAQLLPPPAFPSSFLTSFPSLGFPLLPHSQRLPSPLSADSAAGCSQLDFNPTPLSPSPHCLPDAPLPRPAPLSPLPPLPLSAALTLLSPSF

SEQ ID NO: 794124 - protein, 83 aa, Homo sapiens
NAGCTVWEGSPTEPAAEIAAAQLLPPPAFPSSFLTSFPSLGFPLLPHSQRLPSPLSADSAAGCSQLDFNPTPLSPLTLLSPSF

SEQ ID NO: 794125 - protein, 110 aa, Homo sapiens; identical to SEQ ID NO: 794123

SEQ ID NO: 794126 - protein, 110 aa, Homo sapiens; identical to SEQ ID NO: 794123

SEQ ID NO: 794127 - protein, 70 aa, Homo sapiens
TVQGNKRWIHTCQPLRTVGAHLWERHSDLGHIIHFRFRESLNNWEQTGKQRLTSFFPSKGDVLGGIILSK

SEQ ID NO: 794128 - protein, 87 aa, Homo sapiens
SVNSREKQLSHTPQAEPERDAHAQGGRAQHLRSQHHLCTGHHLAGTEWVLRGGAGTPGRVSTQRKLQTPHTSTSASPDLDLTGLGLT

SEQ ID NO: 794129 - protein, 102 aa, Homo sapiens
MRSFKSLIFSSRPHSLPGRDVGTSCSCQAGNRSLSMSTGSALTPRKDCDKHGLTCGSTQPAVSTLLFSRMQHLMFCQEAVELHIEVASVSSHSKMEISLSLF

SEQ ID NO: 794130 - protein, 101 aa, Homo sapiens
KSKLKKWKLQIHQAPEMLIDFFVERKIISFDGCIAQLFFLHFAGASEMFLLTVMAFDLYTAICRPLHYATIMNQRLCCILVALSWRGGFIHSIIQEPKGTD

SEQ ID NO: 794131 - protein, 120 aa, Homo sapiens
MPFTNNDFGKSLFLFKLQYSQLKSTERNPYPLKLLHTISTYKITLSGQAQWLMPVIPGLWEAEAGRSLEARSLRTAWQHGETSCTNITKISWAWWHTPVVPATWKPEVRGLLEPRRSRLQ

SEQ ID NO: 794132 - protein, 110 aa, Homo sapiens
PWVVALEMFAAAVFDPIFWVKHPKEGEALKSKEHLRIESQGKFDLCYDNVPSNLQFSNFLVSNLLNVENCLHGYFHQYLLYFKTEKNLGQGWWLAPIIPALWEAEAGGLL

SEQ ID NO: 794133 - protein, 106 aa, Homo sapiens
MLVNGHYQEFKTRFGIMTSGQTHMQNLPFGPFSRASSAASGSSSFSELSVCVLACPLTDIILLGTVAFTFDDVGKEDPATTTSCCFCNAAYKPRESEDTLTRKASK

SEQ ID NO: 794134 - protein, 137 aa, Homo sapiens
EIFCKSGNDTGQGLCSPGLRPPTGTFLHPSVNRPQAPPQVFLCELVGRPGPGPGFAAPCLPPPWRCGASGWAWEAGNTFGNSRLRQLWTEDPAQQPRELASPLSLPTPTRPSCCFHGSGTRRILSQELPRRALIFNP

SEQ ID NO: 794135 - protein, 136 aa, Homo sapiens
IAPSLLLFRRPGLCSPGLRPPTGTFLHPSVNRPQAPPQVFLCELVGRPGPGPGFAAPCLPPPWRCGASGWAWEAGNTFGNSRLRQLWTEDPAQQPRELASPLSLPTPTRPSCCFHGSGTRRILSQELPRRALIFNP

SEQ ID NO: 794136 - protein, 115 aa, Homo sapiens
THSGLPFGQAGASATGKERQAEVPTATLQLGCTQGVQAPGPVESCGRDCRKREAAPGPQAGGRGSGGRGVEAPSGWGRAWGPRVLKWRGFGQGHHAGQKLGEIHGVQVGSCPCRG

SEQ ID NO: 794137 - protein, 131 aa, Homo sapiens
RESCVPAGAPHPPCRGSWQWRCWLRSTDLRPRLGPEMPGASAWARWGDFGSPECKLYHFEGPRQAPQPPVHRGCRGDDAEGRSRWRTWGLTGSWLQTLRRHVQRPSCCFHGSGTRRILSQELPRRALIFNP

SEQ ID NO: 794138 - protein, 150 aa, Homo sapiens
EIFCKSGNDTGQGLCSPGLRPPTGTFLHPSVNRPQAPPQVFLCELVGRPGPGPGFAAPCLPPPWRCGASGWAWEAGNTFGNSRLRQLWTEDPAQQPRELASPLSLPTPTWPGSCLTRKGIKAGLGWRLENPETSAGLDPATHQAVLKATE

SEQ ID NO: 794139 - protein, 730 aa, Homo sapiens
MPGKFFAFLVEAEFHHVAQAGLELLTQVIRPPQPPKCWDYRCEPPHPAFFLFFLRKWSNVLVVMLSRDLEECALFTLKIVGDKISYGNTNSFFLIAFKGNIQRKGKLDAVVEGFPVSLSERFRNKEILTSCCNRQTLNLSGFSTTDMYFLFISQSNMNGGIFLHFAATLRASAIRVDKDGSGCIAHSCLGLEPAFSLLSQLHDPNLTVRCLGKVGEYLGVTNLTLTVFATRRKLVTDSVLISIVPGEIRTLKDGGGRRRWYCLWWRGRKLKYITGSDETHRSETGKAGLKWCAEEGNGCRFTISMEPTKTKVNSGTTNYAALNVITLLQIYYIKRTFLDIFPLTLNIFKIYRKIERIVQYERLYTHYLRSAVIHVLPYLLCIAICKYVNFFPNTLKICCRHNIYHNISYNCNAIIISKIILYSYYTHTHDEYNQFIFNLYSNFPNYLKMTFISLILSLFFKQSSQIVFMFISLVSFNLKIPLFLFYSIYFLKTWQDSCIVPHSGFVWFLLHAVVLLVLILFGFLINYNGSNGLIRFKLKFLARIFHEVIFLFHVTSQQKAYNARFFTENDVKFDHFVGMVITKSLHCEGLFFTLQLATNLLVNTLAPCEYLNNLSPKYFKMHCRSLPEIIISLGGIKSVIFLIYIIFSIFSSCHCSVKNNFASSTGTELHFFLKKQDIFIFKKIIGNFEYREKPKSSAVISTASELMLKMLCTISFHSFFNTDKDIYYKI

SEQ ID NO: 794140 - protein, 109 aa, Homo sapiens
RLIHPRPGEWKSTSRARGAGARRGAEKYRRRSRGENKDDATAVLRPSRPPTPADFNLLSLFKTSRRSASSSFSGCAFCTAMETGLAERLPFGQQARPLRKRPQWGARRS

SEQ ID NO: 794141 - protein, 156 aa, Homo sapiens
MASHLTLPVMSCLFICSHQRGCAVRDDRGCVSLRTVEAHSGFGDEAFPAPVSRPPSFHALPCFAVPCLTSSLGLPEQEGLQGALWSSLPHLDPRQGRRACLLSAGTRGGRMWPARQGGPWGPFQELSAAQASPLVQPGLCTPFCHPLTPQEVIHGS

SEQ ID NO: 794142 - protein, 142 aa, Homo sapiens
ALFQQVTTYVSFLLGYNSFSIENRSDLIFFLSFYKTINSSNKLTSLGRKKAWLRVWNYILHWLSECPNIDLINSQTNIKVKLCARKIEEQGKKGVGAWDFTVAATGRVETFVGNFSLFLSRVDNPLFHYRQTGFILLLPLEF

SEQ ID NO: 794143 - protein, 302 aa, Homo sapiens
SLEGGDRPLSWEESTEHSSLALNSGLPNGETSSGGQPRLAEPDIYQEKLSQVRDVRSKDLGSSTDLGTSLPLDSWVNITRFCDSQLKHGAPRPGMKSSPHDSHTCVTYPERNHILLHPHWNQDTEQETSELESLYQASLQASQAGCSGWGQQDTAWHPLSQTGSADGMGRRLHSAHDPGLSKTSTAEMEHGLHEARTVRTSQATPCRGLSRECGEDEQYSAENLRRISRSLSGTVVSEREEAPVSSHSFDSSNVRKPLETGHRCSSSSSLPVIHDPSVFLLGPQLYLPQPQFLSPDVLMPTM

SEQ ID NO: 794144 - protein, 184 aa, Homo sapiens
KAFSFYSSYLRHERTHTGEKPYECKQCSKAFPFYSSYLRHERTHTGEKPYKCKQCSKAFPDSSSCLIHERTHTGEKPYTCKQCGKAFSVSGSLQRHETTHSAEKPYACQQCGKAFHHLGSFQRHMIRHTGNGPHKCKICGKGFDCPSSLQSHERTHTGEKPYECKECGKAFASLSSLHRHKKTH

SEQ ID NO: 794145 - protein, 94 aa, Homo sapiens
MSSPEPPTEPPEPDNPTWSTQPTYSNLGQIRAHLLPSKACRLRTPGSLSTNPEPLPPPLPKKILTRTQSLPTRRTLHPSSIQVQPPRRPFLGSH

SEQ ID NO: 794146 - protein, 93 aa, Homo sapiens
MLPRPKAPASPRRPQTPTPSEQDADPGPASPRDTEAQRLRFRQFQYHVASGPHLALGQLWTLCRQWLRPEARSKEQMLELLVLEQFLGALPSK

SEQ ID NO: 794147 - protein, 93 aa, Homo sapiens; identical to SEQ ID NO: 794146

SEQ ID NO: 794148 - protein, 155 aa, Homo sapiens
QALMARCTVSSGSVCTSVLFLHFKPCELTCFLPQGICLLMVPAVKNQASGSARGATKVRRKCQAGCQNEHLGELDDGTDGKNQLNIRENGGRGQNCEQELEESVAEKDLSQTSRDLEKMMSKHIFLKPMLSISDLVNFLIVPNLANEKVLQGQVW

SEQ ID NO: 794149 - protein, 1007 aa, Homo sapiens
MEVFPLLLVLSVWWSRTWDSANADSIIHIGAIFDESAKKDDEVFRTAVGDLNQNEEILQTEKITFSVTFVDGNNPFQAVQEACELMNQGILALVSSIGCTSAGSLQSLADAMHIPHLFIQRSTAGTPRSGCGLTRSNRNDDYTLSVRPPVYLHDVILRVVTEYAWQKFIIFYDSEYDIRGIQEFLDKVSQQGMDVALQKVENNINKMITTLFDTMRIEELNRYRDTLRRAILVMNPATAKSFITEVVETNLVAFDCHWIIINEEINDVDVQELVRRSIGRLTIIRQTFPIPQNISQRCFRGNHRISSTLCDPKDPFAQNMEISNLYIYDTVLLLANAFHKKLEDRKWHSMASLSCIRKNSKPWQGGRSMLETIKKGGVSGLTGELEFGENGGNPNVHFEILGTNYGEELGRGVRKLGCWNPVTGLNGSLTDKKLENNMRGVVLRVVTVLEEPFVMVSENVLGKPKKYQGFSIDVLDALSNYLGFNYEIYVAPDHKYGSPQEDGTWNGLVGELVFKRADIGISALTITPDRENVVDFTTRYMDYSVGVLLRRAEKTVDMFACLAPFDLSLWACIAGTVLLVGLLVYLLNWLNPPRLQMGSMTSTTLYNSMWFVYGSFVQQGGEVPYTTLATRMMMGAWWLFALIVISSYTANLAAFLTITRIESSIQSLQDLSKQTEIPYGTVLDSAVYEHVRMKGLNPFERDSMYSQMWRMINRSNGSENNVLESQAGIQKVKYGNYAFVWDAAVLEYVAIYDPDCSFYTIGNTVADRGYGIALQHGSPYRDVFSQRILELQQNGDMDILKHKWWPKNGQCDLYSSVDTKQKGGALDIKSFAGVFCILAAGIVLSCFIAMLETWWNKRKGSRVPSKEDDKEIDLEHLHRRVNSLCTDDDSPHKQFSTSSIDLTPLDIDTLPTRQALEQISDFRNTHITTTTFIPEQIQTLSRTLSAKAASGFTFGNVPEHRTGPFRHRAPNGGFFRSPIKTMSSIPYQPTPTLGLNLGNDPDRGTSI

SEQ ID NO: 794150 - protein, 248 aa, Homo sapiens
MEVFPLLLVLSVWWSRTWDSANADSIIHIGAIFDESAKKDDEVFRTAVGDLNQNEEILQTEKITFSVTFVDGNNPFQAVQEACELMNQGILALVSSIGCTSAGSLQSLADAMHIPHLFIQRSTAGTPRSGCGLTRSNRNDDYTLSVRPPVYLHDVILRVVTEYAWQKFIIFYDSEYDIRGIQEFLDKVSQQGMDVALQKVENNINKMITTLFDTMRIEELNRYRDTLRRAILVMNPATAKSFITEMSF

SEQ ID NO: 794151 - protein, 152 aa, Homo sapiens
LVSAPDAMAIMAAGPHGLRPSGFSCFLLSITLPFATISGDTSTDPHGSGPPPPPTEPRVQVHDAKFRAQINQTNTFNMNMQTLCCDVRRGLTSYASACNRQDSTATNCKGEPMFICTGFAGKLLEVRPLTQASSHEVFVIAAAVVKCACFRQ

SEQ ID NO: 794152 - protein, 74 aa, Homo sapiens
KQLCSYGQIELLESVSSLVKWTILLKEIEGLTDSIQGIDKRSPRRLHRASSGGWKFNIKAQADQQIQCLFSPPE

SEQ ID NO: 794153 - protein, 197 aa, Homo sapiens
WQGGNQDNNYLLHKTKYDTDDSLLCDAGTAISGGKAEGEKGRRRSSPARSRIKQGRSSSFPGRRRPRGGAHGGRGRGRARLKSTASSIETLVVADIDSSPSKEEEEEDDDTMQNTVVLFSNTDKFVLMQDMCVVCGSFGRGAEGHLLACSQCSQCYHPYCVNSKITKVMLLKGWRCVECIVCEVCGQASDPSRLLLC

SEQ ID NO: 794154 - protein, 716 aa, Homo sapiens [sequence omitted]

SEQ ID NO: 794155 - protein, 583 aa, Homo sapiens
MKDVQTSTPAEQDLEMASEGEQKRLEEYENNQPQVKNQIHSRDDLDDIIQSSQTVSEDGDSLCCNCKNVILLIDQHEMKCKDCVHLLKIKNTFCLWKRLIKLKDNHCEQLRVKIRKLKNKASVLQKRISEKEEIKSQLKHEILELEKELCSLRFAIQQEKKKRRNVEELHQKVREKLRITEEQYRIEADVTKPIKPALKSAEVELKTGGNNSNQVSETDEKEDLLHENRLMQDEIARLRLEKDTIKNQNLEKKYLKDFEIVKRKHEDLQKALKRNGETLAKTIACYSGQLAALTDENTTLRSKLEKQRESRQRLETEMQSYHCRLNAARCDHDQSHSSKRDQELAFQGTVDKCRHLQENLNSHVLILSLQLSKAESKSRVLKTELHYTGEALKEKALVFEHVQSELKQKQSQMKDIEKMYKSGYNTMEKCIEKQERFCQLKKQNMLLQQQLDDARNKADNQEKAILNIQARCDARVQNLQAECRKHRLLLEEDNKMLVNELTHSKEKECQYEKEKAEREVAVRQLQQKRDDVLNKGSATKALLDASSRHCTYLENGMQDSRKKLDQMRSQVCMQLCTPTTVNL

SEQ ID NO: 794156 - protein, 67 aa, Homo sapiens
MEREVDDRLGLLYNSARPKPKEILSGRGIAVGHIKGHRPDLSPTCLQALPGPLIHVFTDNFGALIIF

SEQ ID NO: 794157 - protein, 433 aa, Homo sapiens
MAFVLILVLSFYELVSGQWQVTGPGKFVQALVGEDAVFSCSLFPETSAEAMEVRFFRNQFHAVVHLYRDGEDWESKQMPQYRGRTEFVKDSIAGGRVSLRLKNITPSDIGLYGCWFSSQIYDEEATWELRVAALGSLPLISIVGYVDGGIQLLCLSSLFQPSPWRLASILLGLLCGALCGVVMGMIIVFFKSKGKIQAELGMCHVLSLPHMVLPGPSLIHSLSLWTTLAAGWTGSTDWRRKHGQAELRDARKHAVEVTLDPETAHPKLCVSDLKTVTHRKAPQEVPHSEKRFTRKSVVASQGFQAGKHYWEVDVGQNVGWYVGVCRDDVDRGKNNVTLSPNNGYWVLRLTTEHLYFTFNPHFISLPPSTPPTRVGVFLDYEGGTISFFNTNDQSLIYTLLTCQFEGLLRPYIQHAMYDEEKGTPIFICPVSWG

SEQ ID NO: 794158 - protein, 464 aa, Homo sapiens
MAFVLILVLSFYELVSGQWQVTGPGKFVQALVGEDAVFSCSLFPETSAEAMEVRFFRNQFHAVVHLYRDGEDWESKQMPQYRGRTEFVKDSIAGGRVSLRLKNITPSDIGLYGCWFSSQIYDEEATWELRVAALGSLPLISIVGYVDGGIQLLCLSSGWFPQPTAKWKGPQGQDLSSDSRANADGYSLYDVEISIIVQENAGSILCSIHLAEQSHEVESKVLIGVFQPSPWRLASILLGLLCGALCGVVMGMIIVFFKSKGKIQAELDWRRKHGQAELRDARKHAVEVTLDPETAHPKLCVSDLKTVTHRKAPQEVPHSEKRFTRKSVVASQGFQAGKHYWEVDVGQNVGWYVGVCRDDVDRGKNNVTLSPNNGYWVLRLTTEHLYFTFNPHFISLPPSTPPTRVGVFLDYEGGTISFFNTNDQSLIYTLLTCQFEGLLRPYIQHAMYDEEKGTPIFICPVSWG

SEQ ID NO: 794159 - protein, 808 aa, Homo sapiens
MSLSGLGLKVMLTLKMNCEVFPLFYALVGVRLIFFKTYVVLKYLLEFTREVILACYFLFLSKFCFHSFFIVKYIELECIHKQMQHNLKSSSMNFDKCINLFNFHCKQNIVNFRQLKSPLVPIYLQYLSLPQPQATNDFHVLICHLYTSLVSFLFISFAHLFFYFFFFETESCYVTQAGLELLGLGDPPASASQVVGTTGTHYYFGLPIFKSGCLFSYYCVLYTVGYSTFPRISCKWTQTYCCVWPLLFSVMFLSFILACYVYQCLIQFLLLHSIGLYSYTTICLFILLLMEYWLFPVFSYYYYYFFFLRRSLALSPGWSAVVQSRLTATSASQVQTILLPQPPESAGTTGLCHHAQLIFIFLVETGFHHVGQDGLDLLTSCSAHLGLPKCWDYRCEPPRLVFFVCFVLFLDRVSLCEPRLECSGMISAHYKPAPLRFKRFLCPSLLSSWGYSVCHHAWLIFVLVVETGFCHVGQAGLELLTSSDLPALASQSVGITSVSHHTRPGMSFFITAINFSFEVKLFLASDSYLIFFVVLAHILIGLCYYGSLCILDLSFCIWCEASVKFNFFSTNILLFQYLLMIRLSFPPLNYLNALMKSNWPYVCGSTFGLYNSVPVIYMSTLMSIPHYFDYCCFIVSDIMLPEITFSTFILLLMVALAIRGPLHFRRHFRINLSIATKNAVIGIVVNLETNLGRMVILTVSSFRSMSIFSLSIGLLKFILAVFYGFYCRGLTHFVTFVAMCLTFFDTSVNGNFFFYVLVVHYYTKSSLGDYYNILLKICEWRETREVELAVSRDRTTALQPGRQSKTPS

SEQ ID NO: 794160 - protein, 147 aa, Homo sapiens
RRICCYQCKGQAEAGAENLLSPAAARLSPSEGSPSFAEMMNDWMPIAKEYDPLKAGSIDGTDEDPHDRAVWRAMLARYVPNKGVIGDPLLTLFVARLNLQTKEDKLKEVFSRYGDIRRLRLVRDLVTGFSKGYAFIEYKEERAVIKA

SEQ ID NO: 794161 - protein, 102 aa, Homo sapiens
GLRTSPPARPTQSPEPWRSHPKPPVPAAAVFFTCSREGLHLRAEVRPWAGARSQRGHSGSARLSRSPSSRREISETKARLGELLPFPPPASLKHSYTESSAL

SEQ ID NO: 794162 - protein, 124 aa, Homo sapiens
MGSSSEASFRSAQASCSGARRQGLGRGDQNLSVMPPNGRAQTHTPGWVSDPLVLGAQVHGGCRGIEALSVSSGSWSSATVWILTGLGLGLSRPFLPGATVLRDRPLGSAFELSYDQKKAPLRLQ

SEQ ID NO: 794163 - protein, 86 aa, Homo sapiens
MGSSSEASFRSAQASCSGARRQGLGRGDQNLSVMPPNGRAQTHTPGWVSDPLVLGAQVHGGCRGIEALSVSSGSWSSATVWILTVQ

SEQ ID NO: 794164 - protein, 355 aa, Homo sapiens
MDYTLDLSVTTVTDYYYPDIFSSPCDAELIQTNGKLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 794165 - protein, 136 aa, Homo sapiens [sequence omitted]

SEQ ID NO: 794166 - protein, 152 aa, Homo sapiens
TRPCQTGGFCIDFTSEMSAGFRVSRAASAASMQNPPGPVKLVMESICIMKGMKPERKPDPSGSGKMIEDYWGVSKKILGDLKFLESLKTYDKDNIPPLTMKRIRERFINHPEFQPAVIKNVSSACEGLCKWVRAMEVYDRVAKVVAPKRERL

SEQ ID NO: 794167 - protein, 127 aa, Homo sapiens
QITPTCPALTVPSGWTLTGPVTELGPAWSHQCVSLNHPISSAVNRAGRGQVSCLPQGSRRPYLSDPIHSSQQTHEAGIVIFIVQSRKWVHTEVKRLAQVTQLGRGCDLNSVFWLQSPHRVTQGTTKS

SEQ ID NO: 794168 - protein, 419 aa, Homo sapiens
MVFSAVLTAFHTGTSNTTFVVYENTYMNITLPPPFQHPDLSPLLRYSFETMAPTGLSSLTVNSTAVPTTPAAFKSLNLPLQITLSAIMIFILFVSFLGNLVVCLMVYQKAAMRSAINILLASLAFADMLLAVLNMPFALVTILTTRWIFGKFFCRVSAMFFWLFVIEGVAILLIISIDRFLIIVQRQDKLNPYRAKVLIAVSWATSFCVAFPLAVGNPDLQIPSRAPQCVFGYTTNPGYQAYVILISLISFFIPFLVILYSFMGILNTLRHNALRIHSYPEGICLSQASKLGLMSLQRPFQMSIDMGFKTRAFTTILILFAVFIVCWAPFTTYSLVATFSKHFYYQHNFFEISTWLLWLCYLKSALNPLIYYWRIKKFHDACLDMMPKSFKFLPQLPGHTKRRIRPSAVYVCGEHRTVV

SEQ ID NO: 794169 - protein, 136 aa, Homo sapiens
SVYISVAPWGGWPQFQCRCKSGSLQHLQLIDSSRPPSPRTKPVLSSPVSEQSQNPHHPPPGLRKFCFKSLFLHCTMGNAVCGGHLPTNTAAVRHTRLLKIHGNCWVWWLMPVIPALWEAEAGGLLECRSSRPAWAT

SEQ ID NO: 794170 - protein, 499 aa, Homo sapiens
RATEGCELAQPQVTLAVGGPPAWSRDPPRHLQTELDGPMNTDLAAGKMASAACSMDPIDSFELLDLLFDRQDGILRHVELGEGWGHVKDQQVLPNPDSDDFLSSILGSGDSLPSSPLWSPEGSDSGISEDLPSDPQDTPPRSGPATSPAGCHPAQPGKGPCLSYHPGNSCSTTTPGPVIQVPEASVTIDLEMWSPGGRICAEKPADPVDLSPRCNLTVKDLLLSGSSGDLQQHHLGASYLLRPGAGHCQELVLTEDEKKLLAKEGITLPTQLPLTKYEERVLKKIRRKIRNKQSAQESRKKKKEYIDGLETRMSACTAQNQELQRKVLHLEKQNLSLLEQLKKLQAIVVQSTSKSAQTGTCVAVLLLSFALIILPSISPFGPNKTESPGDFAPVRVFSRTLHNDAASRVAADAVPGSEAPGPRPEADTTREESPGSPGADWGFQDTANLTNSTEELDNATLVLRNATEGLGQVALLDWVAPGPSTGSGRAGLEAAGDEL

SEQ ID NO: 794171 - protein, 38 aa, Homo sapiens
MIWPYALGFSKGRAWTSFPSFLEICTGNVSKISPAIVK

SEQ ID NO: 794172 - protein, 188 aa, Homo sapiens
MTPTAFFSSPNTAGGMTPTASSSQHTAGGMTPTVFSSQHTAGGMTPTVFSSQHTAGGMTPTASSSQHTAGGMTPTVFSSPHTAGGMTPTVFSSPHTAGGMTPTVFSSPHTAGGMTPTASSSQHTAGVMTPTASSSPHTAGGMTPTAFSSPNTAGGMTPTASCSPHTHCRGSDPHILMQWFLWSLTVQH

SEQ ID NO: 794173 - protein, 143 aa, Homo sapiens
WEGSSQGQTKPSIESTREEKERWIRSKYEHKLFLAPLPCTELSLGQHLLRATADEDLRTAILLLAHGSREEVNETCGEGDGCTALHLACRKGNVVLAQLLIWYGVDVMARDAHGNTALTYARQASSQECINVLLQYGCPDECV

SEQ ID NO: 794174 - protein, 86 aa, Homo sapiens
GVQWCDAPSRLSARCNLRNLRLPGSVDSLDSASCDWTTGMHHHTRLILVETGVSPCWAGLSRTPDLVTPDLVIRLPRPHEVLGLQA

SEQ ID NO: 794175 - protein, 343 aa, Homo sapiens
MNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWGHLPPQPNSLDSGLLCLPCPSSHCPLASLSGSQALLWPGCPLLYGLE

SEQ ID NO: 794176 - protein, 342 aa, Homo sapiens
MNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWDCGSFLLPVIAPSCVDVAWPCLDASLAHHLIGGAGKATPTHFSHWP

SEQ ID NO: 794177 - protein, 88 aa, Homo sapiens
NQSASSTGALQKKASKISSFLRSLRATPGSKTRVTSHDREVDIVAKMVEKQNIEAKVEKAQGGQELEMISGTMTSEKTEMIVFETKSI

SEQ ID NO: 794178 - protein, 239 aa, Homo sapiens
MASTAVQLLGFLLSFLGMVGTLITTILPHWRRTAHVGTNILTAVSYLKGLWMECVWHSTGIYQCQIYRSLLALPQDLQAARALMVISCLLSGIACACAVIGMKCTRCAKGTPAKTTFAILGGTLFILAGLLCMVAVSWTTNDVVQNFYNPLLPSGMKFEIGQALYLGFISSSLSLIGGTLLCLSCQDEAPYRPYQAPPRATTTTANTAPAYQPPAAYKDNRAPSVTSATHSGYRLNDYV

SEQ ID NO: 794179 - protein, 239 aa, Homo sapiens; identical to SEQ ID NO: 794178

SEQ ID NO: 794180 - protein, 174 aa, Homo sapiens
ESLCPWFALPPYTSCPLLGYYADNWKDHLRGKDPPMTKAFFDTAEESPFCMYHYFVDIITWNKNVRRGDITIKLRDKAGNTTESKINHEPTTFQKYHQVSLLARFNQDLDKVAAISLMFSTGSLIGPRYKLRILRMKLRSLAHPERPQLCRYDLVLMENVETVFQPILGPELQL

SEQ ID NO: 794181 - protein, 116 aa, Homo sapiens
CSEDPRSESQYRCHLLSYYADNWKDHLRGKDPPMTKAFFDTAEESPFCMYHYFVDIITWNKNVRRGDITIKLRDKAGNTTESKINQISNRPKVQAQDSPNEVKVPCPSGEASAVSV

SEQ ID NO: 794182 - protein, 141 aa, Homo sapiens
GIELGTEGDTGEESPFCMYHYFVDIITWNKNVRRGDITIKLRDKAGNTTESKINHEPTTFQKYHQVSLLARFNQDLDKVAAISLMFSTGSLIGPRYKLRILRMKLRSLAHPERPQLCRYDLVLMENVETVFQPILGPELQL

SEQ ID NO: 794183 - protein, 172 aa, Homo sapiens
CSEDPRSESQYRCHLLSYYADNWKDHLRGKDPPMTKAFFDTAEESPFCMYHYFVDIITWNKNVRRGDITIKLRDKAGNTTESKINHEPTTFQKYHQVSLLARFNQDLDKVAAISLMFSTGSLIGPRYKLRILRMKLRSLAHPERPQLCRYDLVLMENVETVFQPILGPELQL

SEQ ID NO: 794184 - protein, 85 aa, Homo sapiens
FIAKDSRHVAQTHLKLLDPDNPHTLASQNAEITAYLKLTSDDMIATPYPELISTYDVGIFHMEINTGKQLIILSGFIRNKWISET

SEQ ID NO: 794185 - protein, 70 aa, Homo sapiens
GAGLSSVMLMYTQAMLLSKSAPLGKCSSCIFKGCFFSAPSTLPTGEPSSGRAHEPHALYPELLCPGCGRS

SEQ ID NO: 794186 - protein, 77 aa, Homo sapiens
MKKSCYPRWNETFEFELQEGAVEALCVEAWDWDLVSRNDFLGKVVIDVQRLRVAQQEEGWFRLQPDQSKSRQHDEQV

SEQ ID NO: 794187 - protein, 183 aa, Homo sapiens
FPLRGLSSASRWPQFLVPRLSFSLRPEAQPRGLPAREQTFPLLDRDCGLFSVILREGGGYVATYQKAVILPPLAVGAHPIPPFVDIIGVSLGRVTSWSGWPLNFPFAPPSSGSDFAVTTLRQGEVPNVVHLTTHALLFSCTVACLIRYNKSVSLRAFASEFEHQSFPIDTSLLTIIFENFVSC

SEQ ID NO: 794188 - protein, 200 aa, Homo sapiens
AEPLEGHRGPQSPAHRKGRLELKGLHPPGPPGEAEGPAPEIPGEQQGAVEDRAPRASPPTACPSHRTPRTKRPGTCGPSPEPPAADGRAGDRGMSEGFLGEAGRGAHCPTERANKGRLLPRCRKALPLQGCWAGGALRQSQGARVQGASPGPPHNPGRGSSQRVLAGAGLGASAQALAKPLPPRGALAALGGLAGKERGC

SEQ ID NO: 794189 - protein, 161 aa, Homo sapiens
MPPEPGSSLGAAGDRWARGGLAERPSRVRGRPRWGHVALPPHQHQLSMHLLPGQLASQLCGLQVLLHIGGQLPSPAFLQAPLGVPRGWGHIDTLSGACPPLSPGPGRGAWLLAPEPPRRPWDRKMGCGHSATNTGSLPMATKMGVHSPRPPRQGFPPHGHS

SEQ ID NO: 794190 - protein, 174 aa, Homo sapiens
MVSIRVGVPCCPQALSPAELGLSHPQPEESHGGQDHSVPRRPTRHGFVKHEKATLRWGPDTLGTHHRGCPGKAPQPPPGPAGKQECRAGVPMHGEPGGLGRALGPCLHTNSCFPAALKGRGGGRRSRPHPCISYTQRVGRRHRPFISHGEAPPGKLPLHPSPCWPPAPQEVTLE

SEQ ID NO: 794191 - protein, 161 aa, Homo sapiens; identical to SEQ ID NO: 794189

SEQ ID NO: 794192 - protein, 393 aa, Homo sapiens
MPPEPGSSLGAAPALHASPAGPARQPAVRPPGSPAHRRPAPQPGFPPSAPWRPRLSPRPVGHGSATPGSAAQTWSAGPRQHPGPGTAPGGGSPHAAPAGPAGAPPSAPEASPTGSPARPAGCPPASAVSSPRPSFSVGRPHCQLQVCVWEGGQGRPAAGRLPPSPGPGSSSAGSRHSLASLFRKRRLTSSPSLVTWAWGGGTLSRVQPLLDTQPVPLLPMVSIRVGVPCCPQALSPAELGLSHPQPEESHGGQDHSVPRRPTRHGFVKHEKATLRWGPDTLGTHHRGCPGKAPQPPPGPAGKQECRAGVPMHGEPGGLGRALGPCLHTNSCFPAALKGRGGGRRSRPHPCISYTQRVGRRHRPFISHGEAPPGKLPLHPSPCWPPAPQEVTLE

SEQ ID NO: 794193 - protein, 170 aa, Homo sapiens
MPSEGQSQERGDRQMERRTRGALGSRRPPPPLPALRHLCTGLQAAGMAWPGTLWRHTCQGRAWAAEGPWGLFRPHRCPREAGQAPVGPSPETQGVAHVCSRARVSVDEREPGGGAYAMHVTPRWKGCHRHSGRTVRGSVSWKRPEQAAPETGRGPAVARGSGDGNECGWG

SEQ ID NO: 794194 - protein, 361 aa, Homo sapiens
WQYLFSNTDTLWRGYERIAGRAPAPRAHGPADPQEQTENGVEWQMLRHLVPGVVCFLPCMEQCVHSHGVIHMALFTPKWWANPSSVSDSHFGFAQHQLMQTDTFTIYAIDLGALTKIRIRHDNTGNRAGWFLDRIDITDMNNEITYYFPCQRWLAVEEDDGQLSRELLPVDESYVLPQSEEGGGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPCRNHTRQGQPFSGAPSPATPTQPQFFLQD

SEQ ID NO: 794195 - protein, 372 aa, Homo sapiens
ESSSEEEEMEEEEEEEEFGPGMQEVIEQHKFEAHRWLARGKEDNELVVELVPAGKPGPERNTYEVQVVTGNVPKAGTDANVYLTIYGEEYGDTGERPLKKSDKSNKFEQGQTDTFTIYAIDLGALTKIRIRHDNTGNRAGWFLDRIDITDMNNEITYYFPCQRWLAVEEDDGQLSRELLPVDESYVLPQSEEGGGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPCRNHTRQGQPFSGAPSPATPTQPQFFLQD

SEQ ID NO: 794196 - protein, 70 aa, Homo sapiens
MHVSINELTRTAMSRAQAPSDTGPKQGLHLCGGSGSDGEAPAPCNVHLTGGFWRATAPSFSGNKYQIWGN

SEQ ID NO: 794197 - protein, 79 aa, Homo sapiens
GSEACGGPWSLLSPPRSRLLNLRATGLYPSVPMLLASQPERLISGPGAPGSFSSAPAGGGALAAIPVRSFFGAAGPAEE

SEQ ID NO: 794198 - protein, 217 aa, Homo sapiens [sequence omitted]

SEQ ID NO: 794199 - protein, 217 aa, Homo sapiens [sequence omitted]

SEQ ID NO: 794200 - protein, 217 aa, Homo sapiens [sequence omitted]

SEQ ID NO: 794201 - protein, 73 aa, Homo sapiens
QVASSRSLHFSPRVFRPPLLPEGTLRGEEAEDSTETSVSGAGAPKAQRAHLPRQRIVRQSKSHTGLLRCAARA

SEQ ID NO: 794202 - protein, 139 aa, Homo sapiens
GQEVAVRVELDSGEEVEDQREGKGQGDGGRVGKSESQIIHGGRLRENRITALPELEDDDRNAREMTGAVAHTCNLSTSGGRSQWITRVQFETSLGSMVKPRLYKKCKKISWVPWHAPVVPATWEAKAGELLEAGRWTFQ

SEQ ID NO: 794203 - protein, 143 aa, Homo sapiens
QSPDTEALSCFLIPVLRSLARLKPTMTLEEGLPLAVQEWEHTSNFDRMIFYEMAERFMEFEAEEMQIQNTQLMNGSQGLSPATPLKLDPLGPLASEVCQQPVYIPKKAASKTRAPRRRQRKAQRPPAPEAPKEIPPEAVKEYV

SEQ ID NO: 794204 - protein, 660 aa, Homo sapiens; identical to SEQ ID NO: 753247

SEQ ID NO: 794205 - protein, 135 aa, Homo sapiens
IKRSEVSLLLSARGCRRRSIVKVSLLPAVMSKSESPKEPKQLRKLFTGRLSFETIDESLRSHFEQWGTLTNCAVMRNPNTRCSRGFGFVTYATVGEVDAAVNARPQKVDGRVVEPKRAVSREDSQRPVAYLTVKK

SEQ ID NO: 794206 - protein, 105 aa, Homo sapiens
CSYAVYTSLYSISVPVPSVGLVSRLCCKVSVLVLSVGLASLLCCKVLWLGEGVWSRVGREVEGGAHSQLYLDSWRKESCCYQEKSVLIRQEEDLLPSFGGWVLLG

SEQ ID NO: 794207 - protein, 302 aa, Homo sapiens
LTLSSAESNPRPIVKITERFFRNPAKPAEEDVAERVFLVAEERIQLRYHCREDHITASKREFLRRTEVDSKGNKIIMTPDMCISFEVEPMEHTKKLLYQYEAMMHLKREEKLSRHQVWESELEVLEILKLREEEEAAHTLTISIYDTKRNEKSKEYREAMERMMHEEHLRQVETQLDYLAPFLAQLPPGEKLTCWQAVRLKDECLSDFKQRLINKANLIQARFEKETQELQKKQQWYQENQVTLTPEDEDLYLSYCSQAMFRIRILEQRLNRHKELAPLKYLALEEKLYKDPRLGELQKIFA

SEQ ID NO: 794208 - protein, 302 aa, Homo sapiens; identical to SEQ ID NO: 794207

SEQ ID NO: 794209 - protein, 591 aa, Homo sapiens
ARIETESSWAGSAGQAAPGGLRTVANSSSGLRGPVSSGASDASLESQAGVRGGASRSTLLPNSPAATRGPSLARLCALVDLCLGCSRCTQRLNESTYVLRRVEHDCSREILLARFKQATKSKVWRVVGCRPTFPRPLCYQVCHYYSPGLGCRRHRNRCTFARSREEALVWTFERQHNLQRLWLKAEVQGSGAQGGAGRAADAILTEFGGRFELLCSLCFRRCPPCICRVDPQGQCPEHGACPSLLAHVSAEGRRKQQFVVVRPRPRAGQPPAYCRFVGRGQPCWRGESRCQFAHSAVEMAVWEAEQLGGLQRGDLLTPPAPDGDGRTAPLGQPPGAQLYCPACLVTCHSQEAFENHCASSEHAQMVAFDQALPWEHRSPPPGLSKFELCPKPDLCEYGDACTKAHSAQELQEWVRRTQAVELRGQAAWQDGLVPYQERLLAEYQRSSSEVLVLAETLDGVRVTCNQPLMYQAQERKTQYSWTFAVHSEVSGEQLRLGGGSPGEVVTSARADVNSLGHGANTEALPLSTCVTCSRSLSLSASVSSPRDRGPGQSHLGRVILWSIWVKTRIWPGAVVHACNPSTLGDRGRWIT

SEQ ID NO: 794210 - protein, 90 aa, Homo sapiens
FATIHPGFYGFHRDTFAYECQPQSQAHFPEGEGDFYYIGALFGGSVLEVYRLIMACHQVMMIDQANHIEALWHDESLLNKYLLNHKPTLP

SEQ ID NO: 794211 - protein, 105 aa, Homo sapiens
MRCVKSMAMDANSLCVSGFKQLYTLMLSYTQQQFVTSLGNSSYSFELQPNFLSITALGLTLPEEKGKTQPECPLKVKKCPHFYVQIGIYIQTSWRSQTNKILNLY

SEQ ID NO: 794212 - protein, 102 aa, Homo sapiens
MRCVKSMAMDANSLCVSGFKQLYTLMLSYTQQQFVTSLGNSSYSFELQPNFLSITALGLTLPEEKGKTQPECPLKVKKCPHFYVQIVDLWNLHSTFDTACDS

SEQ ID NO: 794213 - protein, 94 aa, Homo sapiens
LLLSHRPKAVEAHTRVVEEDGEEWSESGCVLKMGPAGLTSSLDEGSDRDRRVKAGFETLGSSTSKDSIATNSNVWRRLGRRVQNSDISVEVSSK

SEQ ID NO: 794214 - protein, 158 aa, Homo sapiens
LHWLLKSKQSKMSTQARVDTPLTHSQRPPGHSPKKQKQSGFVFSSPCGPLRPAPLSRNRELGAHAIWRDWAAFAFSCHSWGKAKGMQPSPCAQLPGNPRGRASGGTGVYQNHSGQSVHRAVSLAGAPRALLWKPQTPETVLILSSTPQNPASIFLSST

SEQ ID NO: 794215 - protein, 2292 aa, Homo sapiens
MTMAAAAVVARGAGARAATAAALRGGCGTAARGRPCAGPARPLCTAPGTAPDMKRYLWERYREAKRSTEELVPSIMSNLLNPDAIFSNNEMSLSDIEIYGFDYDYTLVFYSKHLHTLIFNAARDLLINEHRYPAEIRKYEYDPNFAIRGLHYDVQRAVLMKIDAFHYIQLGTVYRGLSVVPDEEVIEMYEGSHVPLEQMSDFYGKSSHGNTMKQFMDIFSLPEMTLLSCVNEYFLKNNIDYEPVHLYKDVKDSIRDVHIKGIMYRAIEADIEKYICYAEQTRAVLAKLADHGKKMFLITNSPSSFVDKGMSYIVGKDWRDLFDVVIVQAEKPNFFNDKRRPFRKMNEKGVLLWDKIHKLQKGQIYKQGNLYEFLKLTGWRGSRVLYFGDHIYSDLADLTLKHGWRTGAIIPELRSELKIMNTEQYIQTMTWLQTLTGLLEQMQVHRDAESQLVLQEWKKERKEMREMTKSFFNAQFGSLFRTDQNPTYFLRRLSRFADIYMASLSCLLNYDVSHTFYPRRTPLQHELPAWSERPPTFGTPLLQEAQAKSQGQKLETVTAPDWAGMMGLTSCGSELLLLEKIQISLLIFILYLTENNSPNDSRQELAAHPSSLSPHAGLKGKLHIGTLILPFCLLRSWNIRFPGIGRPLDAMSVFYQVKLETVLDSSMEHFLNIYGLCIGNCRGTVMGKDYCFQKADFVGSTMVKRCCEWQRGSPGDGQFPNHLVLKALTFWHITSNRTQPPWKDLSEKEQEKLQLLDPFVLSVWFLRPSPGQERGDESSGQNLPASGTAFYRAFCKKRVGLKNQNICGRSPRSLLNLETPPELVSSAHWKKENEPGKSIFVMKCYAMPPTQLNWNPVENMRFTRNSPLSRWKQTRSWLLSNELPTERCLDWPGEEEDGHHNLAMSSLLLDFTPVMFVRLFGSLYSLFFFFCFVLFFFRCLRWERAKDIEAKERYDLANQAFLISFCFVLLRWSFALIAQAGVQWHNLSSLQPLPPGFKRFSCLSLPSSWDYRHALPHPANFVFLVEMGFLHGGQAGLELLTSDNLPALASQIAGITGVATAPGLLFSFLSRGNASGMYSFCWREESLIAPGFVVSFNVKCIFTALSECYGNVCCYYYGAANTVLIAYAISILLFRLPDLVLLKLILSFCGNLYIFLNLKDGRNMRGACGECLLIQHFYCDKCMYPSIDEIQVWHSMGSLPDGRNLMSYIASFVMLLVIVGMYLGYLAVFNYNGEGDPLDPKGFSPSFLLHFVMNTVRHSSMFFFWNRVGILFIVCLLLGVFAIRVYWRLTLNGCVLRPELLGVGVLKECAGVLGFKFLLWRSRFRKKVLLKNNSWFLSNQIFIDYLPGASYRVFCLLKNEVELFLKPVSMSVHVGDLSFEGEKHFLGMNNEFCNQFPVEKNFSLWAIELGSVEISHVTEAWHLGHQGSLTVYLADCRPMSWRYRGQTQSFPCELMEAHPTLLLILVYTQSGQILTCRCHDFFFFFLRQGLALLPILECSGVISAHCNLLPPRFKQFSCLSLPSSWDYWYMPPGLAKFCSFNRDGVSPCWPGWSQTPSLKCSAHLSLPKCWDSGCEATVMPGLVMTLFSFFFFFFLRFSFALFAQAGVQWHDLGSLQPPPPGFKCFSCLSLPSSWDYRCPPPHPANFFVFLVETGFHHVGQAGLELLTLGNPPALASQGAGITGMSHRAQPIMTQLGSGTLHWVFCSLMCTLMNAYWYKGNESVFSHLKNCVVKQTKIAGTFKNYCLILFDRFSKNYVNNDESRAAAITNMTVQQGPWRSLWKGLAQLIFFFQFVFTGETWLLKYFSCLAESSHFPPNIVPVCFLKHFTLRHYFLLFPLILCNINHLLLIWAYYRLQLLVALNAIGTLNYCKGELKSSLVVLVNLALGKLSGFSSVLFSKGLLSSRDWAKYWNWIPLFCLLICCQRPLGAPCLECSKTKFGQTQGSLIVLFNYREPTFCLLNIDFLLYQVFLSFFFALGAELKVQLTFDTTSVIYVTVIFDTTSVIEELSSKFSYPLTLLVRSRKGREGSTLNAGSANFSCKRPDRKYFWLFGLFAFATTTVGMTMVMAVFQHNLIYQDKLWAVFGPQAVACCPCSNGLCWRQWQDSLAENMQMNNLIAGMQRGESSVGNKCTVFPLSYFLGISYMYGQCVYLSHQAQTLVEYTSHCIEFVIVLVLGAELSCPDDLFQTEGHTPLTAGSAAGWPFTSSPYEEFPLLKSPACPRSYPLPACNPYRLHMGYKGLASSPQLGKPSGAIPAPEPLVGSVRPHCGHITAQCLSLTSLYPAGSAHSTVL

SEQ ID NO: 794216 - protein, 158 aa, Homo sapiens
GSPLIVQDKLHVVPLVNGQLACRCLSVCSWRPLDVQPLVCSFASVFVSTSRSSKITEECAGMQHPEIWRNSLEQPHSVPFLPRNRMFFFMAYYAMRSPRYKTQFCPLSGVPQVCCKWGTAVRLYLPLADGVVGNQLIMNPRLLLSLASYLEVINQLHV

SEQ ID NO: 794217 - protein, 153 aa, Homo sapiens
VTVDDLDDGANGEIESVSIVAGDPLDQFFLAKEGKWLNEYKIKERKQIDWESFPYGYNLTLQAKDKGSPQKCSALKAVYIGNPTRDTVPIRFEKEVYDVSISEFSPPGVVVAIVKLSPEPIDVEYKLSPGEDAVYFKINPRSGLIVTARPLNT

SEQ ID NO: 794218 - protein, 134 aa, Homo sapiens
VTVDDLDDGANGEIESVSIVAGDPLDQFFLAKEGKWLNEYKIKERKQIDWESFPYGYNLTLQAKDKGSPQKCSALKAVYIGNPTRDTVPIRFEKEVYDVSISEFSPPGVVVAIVKLSPEPIDVEYKLSPGEDAV

SEQ ID NO: 794219 - protein, 551 aa, Homo sapiens
MAQFVQVLAEIGDFGRFQIQLLILLCVLNFLSPFYFFAHVFMVLDEPHHCAVAWVKNHTFNLSAAEQLVLSVPLDTAGHPEPCLMFRPPPANASLQDILSHRFNETQPCDMGWEYPENRLPSLKNEFNLVCDRKHLKDTTQSVFMGGLLVGTLMFGPLCDRIGRKATILAQLLLFTLIGLATAFVPSFELYMALRFAVATAVAGLSFSNVTLLTEWVGPSWRTQAVVLAQCNFSLGQMVLAGLAYGFRNWRLLQITGTAPGLLLFFYFWALPESARWLLTRGRMDEAIQLIQKAASVNRRKLSPELMNQLVPEKTGPSGNALDLFRHPQLRKVTLIIFCVWFVDSLGYYGLSLQVGDFGLDVYLTQLIFGAVEVPARCSSIFMMQRFGRKWSQLGTLVLGGLMCIIIIFIPADLPVVVTMLAVVGKMATAAAFTISYVYSAELFPTILRQTGMGLVGIFSRIGGILTPLVILLGEYHAALPMLIYGSLPIVAGLLCTLLPETHGQGLKDTLQDLELGPHPRSPKSVPSEKETEAKGRTSSPGVAFVSSTYF

SEQ ID NO: 794220 - protein, 70 aa, Homo sapiens
MVLDWLSLYTKAVSILVWPCSRKARVTTAPHLHGTQHRGGPGHDGGNRRLRQPGSNVQWLEASAPWSWRP

SEQ ID NO: 794221 - protein, 75 aa, Homo sapiens
EMTVFTYVAPGSPGMPVKSLGERHVPESHSLLSLDPRTKEASEAEPPVADKKPEWEGKLGCCDRPRLASCFGNTA

SEQ ID NO: 794222 - protein, 140 aa, Homo sapiens [sequence omitted]

SEQ ID NO: 794223 - protein, 151 aa, Homo sapiens
SGQPVATVLAIPQGQQQSYVSLRPDLLTVDSAHLYSATGTITSPTGETWTIPVYSAQPRGDPQQLSPALGSQMRWSRTGNDLVLLRFQLQTLPSRWSLVRFPVGKRKTILSGWLKKRLQQGAGKCVSKHSSSRHSRALSRPALRLQRHQRV

SEQ ID NO: 794224 - protein, 675 aa, Homo sapiens
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 794225 - protein, 611 aa, Homo sapiens
MVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 794226 - protein, 514 aa, Homo sapiens
MYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 794227 - protein, 652 aa, Homo sapiens
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFSRSSGLCRSRDLPEDLQQPLRLFGHRVSQTRAGTPAHSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 794228 - protein, 331 aa, Homo sapiens
ILIYRLCYTKINNILSSGLCRSRDLPEDLQQPLRLFGHRVSQTRAGTPAHSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 794229 - protein, 335 aa, Homo sapiens
DSHPHSHATSRATIYYNYRSSGLCRSRDLPEDLQQPLRLFGHRVSQTRAGTPAHSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 794230 - protein, 597 aa, Homo sapiens
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFSRSSGLCRSRDLPEDLQQPLRLFGHRVSQTRAGTPAHSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPSLSQGAKA

SEQ ID NO: 794231 - protein, 181 aa, Homo sapiens
ISGLCRSRDLPEGTSTTSSSLGSYPLSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPQQQQRPVRDGSRKHV

SEQ ID NO: 794232 - protein, 391 aa, Homo sapiens
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTVPAPSSPWTSGITRPEQKPS

SEQ ID NO: 794233 - protein, 449 aa, Homo sapiens
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTVPAPSSPWTSGITGRKPLGEDPPGRQPHFLRELRHLYLGLFCLVWGEPRGPNSVSLQCSIFLMKEKIIKLLFTTRKKN

SEQ ID NO: 794234 - protein, 435 aa, Homo sapiens
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTVPAPSSPWTSGITHFLRELRHLYLGLFCLVWGEPRGPNSVSLQCSIFLMKEKIIKLLFTTRKKN

SEQ ID NO: 794235 - protein, 722 aa, Homo sapiens
MEAHFLDEQFKCTVPLWQYFPKLQMFLYFHRQLCLPEFDSTDGLTRVQNDLFARFVIVALFLIAKDWRQLKCSFAGANEQTMARLNMGYRVAIIHKMDLNALCRIEQQGGLPREEAGLGGVSRSCHQCKREENQKCLCLSMPRGSLGRHRKSVIVMPLEGVLVMGDCLFAGDPMYLLIAEAGECTPFQEIKMGQVRWLTPVIPAVWEADVGGSLEVRGSRPPGQHDEDPISTKNTQISQTWWYMPVIPAALEAEAGESCEPYEAEFTVSQDHAIVLQPELQSETLSQIIKENKLKTYRTVTLPPAQCRKVKVLATSQVQEPHSGPRPLIKKYVLGSHKGAECEGLGVAVVNTTPGPGLGEMEPSLGPLDTLLLADFVIFNPCSDVAHVMISETFGGFPTDRKIHFNSALGIPGPLYWASSGAALGLSPLPLSALLTPHLRAFAHIVPFACLSVQSSLHVPRSCLTFKGQLSFHFCTAFCPPWLLCKLPRSSHTMVPAPKEAPWGPLLATRSSPVVTTHTLALSRGACRCLFGPPTHRVYRTDSSVSGCLPAALSDHPGCLQWPFGFFLCCVGVHQIYHYLFILLWTGIGLCPASSVNSFLSLGARVRSLLGIHPGWVDGLPDSECVCMNEIQVGDEKSRVSWLEPGFLITGTEQVQGSWFRQPAPMVVVALLGCRMLNLQGTYPLSAQWDFSWLERWSHVEGLNNPAKEAERWSIVLNLREN

SEQ ID NO: 794236 - protein, 1302 aa, Homo sapiens
MLGNSHGIPTEQSEDRLLIPLPSLERSGEWVNYSFIEMSFTCHSVYPLLVSNCIHRTTINSQNYSQRWYIFITPSKTPYPWSVTPAFLTPAVQGSHESTFYVRLTYSGHFIYLESCDISFVTGFFHWMFSRAVQVEDVSVLHSFVLLNNTSLYEIDHICLLIHQLMDICVFLLFGYSERCCYEHISTRFCVDIMFSFLLAIYIGVELLGLTVTPCFNFLRNCQTVFYEQLYHFTFPPAMYPGFNLSTSSSTLAIICLFAFSILMSMKCYLVVLICIPLMATDAECLFLLLTGHAYFFGERSIQVLCLFLIELSFFFKFSVFLTTRLPGMSLLFIIELGELFVYSRRQSFIRYMTGKNVLPFCGLFSVSCWCPLRHKTFNFDDFQDTYFFSIVTCAFGAISRKPLPNPRSRRLMPVFSSKNCIVLVLTMVFDPFRVYFYICCDVGVQLHSFACGSPLVPLLIIEKNILSPRNCLGILAKGLCFLLDLLSWDMVSLGSLPFFFLLSLCLVPPVLCCLSTLFLLSPSLPESTVLSPSLSDVPQSSLVHVLAPHTSPWRKVETNDFLFMSHEETESPEKWNNVLRVTIAHSVEGPGLDLYVFLRSSPLGCLSSLYPSDVTTKANDGGLNFNSQKCRRLILSSKFQKKMYIKVCYLKCAISRVFHFSGMPLASALLTFSWLQLKLIAYERIENNKYQKKVHMVIWYQNISAAKFSSSSLPQGSDELKLQVLFFILLTYRKAIALPTAVQGLSCESGGAGLLSQDSSSQGIPTNLWLLNCSFFLQGTPEGNKTDTCAQATILNWKPKAEFLTLRSSRFLRGICKVEINPFLFTRLSFLDEGTELLNGGIIGLLEEGHGMPVERTGWGGEVEALTWGPKQRSGVALVTFAQTAQSPLHRAINLGKALPAVDWSQPGSQVSKSSIASGAGLVTEDLKIINKSMKYTEKPLRLLSVEQREKVPRRSEGVRKQWMIGRGWGIRCSHCLGCRKRNREPRVRVLDPRPSLSMSLFASLGLYLLLLQIQAWGSLKMAPTCHEMNLRGFPFFPPSKSYKKLDVVAHASNPSILGGRGGRITGRQEFETSLGIVVRLHLCLFENKKSLKIAQQAGDLYVCPSWLYTVPPVLLQCKAACFLTWVRLCPSCLWESALAPNWADYFLRKLMGAPRYSLPARGQTQCRHSLCHWCNVRVYMCTWVPSLAHEFAMSTARSSLSLARCGDDCCSLRIWGKQAPSELDDPLLILCDLLEKWMKLVALAFLDSVSGTGQGPQSRARSLERVSHMTGFTQALPLGLHALCHLTGPGLQVGNVCTLF

SEQ ID NO: 794237 - protein, 1266 aa, Homo sapiens
MSFTCHSVYPLLVSNCIHRTTINSQNYSQRWYIFITPSKTPYPWSVTPAFLTPAVQGSHESTFYVRLTYSGHFIYLESCDISFVTGFFHWMFSRAVQVEDVSVLHSFVLLNNTSLYEIDHICLLIHQLMDICVFLLFGYSERCCYEHISTRFCVDIMFSFLLAIYIGVELLGLTVTPCFNFLRNCQTVFYEQLYHFTFPPAMYPGFNLSTSSSTLAIICLFAFSILMSMKCYLVVLICIPLMATDAECLFLLLTGHAYFFGERSIQVLCLFLIELSFFFKFSVFLTTRLPGMSLLFIIELGELFVYSRRQSFIRYMTGKNVLPFCGLFSVSCWCPLRHKTFNFDDFQDTYFFSIVTCAFGAISRKPLPNPRSRRLMPVFSSKNCIVLVLTMVFDPFRVYFYICCDVGVQLHSFACGSPLVPLLIIEKNILSPRNCLGILAKGLCFLLDLLSWDMVSLGSLPFFFLLSLCLVPPVLCCLSTLFLLSPSLPESTVLSPISLDVPQSSLVHVLAPHTSPWRKVETNDFLFMSHEETESPEKWNNVLRVTIAHSVEGPGLDTLSLLRSSPLGCLSSLYPSDVTTKANDGGLNFNSQKCRRLILSSKFQKKMLIKVCYLKCAISRVFHFSGMPWHLLFLPSRGCSYKLIAYERIENNKYQKKVHMVIWYQNISAAKFSSSSLPQGSDELKLQVLFFILLTYRKAIALPTAVQGLSCESGGAGLLSQDSSSQGIPTNLWLLNCSFFLQGTPEGNKTDTCAQATILNWKPKAEFLTLRSSRFLRGICKVEINPFLFTRLSFLDEGTEAVEWRNNRFAGGGAWYACGKDRMGWGGRGFDLGSKTKVRCCPSDLFAQTAQSPLHRAINLGKALPAVDWSQPGSQVSKSSIASGAGLVTEDLKIINKSMKYTEKPLRLLSVEQREKVPRRSEGVRKQWMIGRGWGIRCGHCLGCRKRNREPRVRVLDPRPSLSMSLFASLGLYLLLLQIQAWGSLKMAPTCHEMNLRGFPFFPPSKSYKKLDVVAHASNPSILGGRGGRITGRQEFETSLGIVVRLHLCLFENKKSLKIAQQAGDLYVCPSWLYTVPPVLLQCKAACFLTWVRLCPSCLWESALAPNWADYFLRKLMGAPRYSLPARGQTQCRHSLCHWCNVRVYMCTWVPSLAHEFAMSTARSSLSLARCGDDCCSLRIWGKQAPSELDDPLLILCDLLEKWMKLVALAFLDSVSGTGQGPQSRARSLERVSHMTGFTQALPLGLHALCHLTGPGLQVGNVCTLF

SEQ ID NO: 794238 - protein, 67 aa, Homo sapiens
MSRDDLVQICGPADGIRLFNAIKGRNVRPKMTIYVCQELEQNRVPLQQKRDGSGDSNLSVYHAIFVG

SEQ ID NO: 794239 - protein, 1038 aa, Homo sapiens
MKCYLVVLICIPLMATDAECLFLLLTGHAYFFGERSIQVLCLFLIELSFFFKFSVFLTTRLPGMSLLFIIELGELFVYSRRQSFIRYMTGKNVLPFCGLFSVSCWCPLRHKTFNFDDFQDTYFFSIVTCAFGAISRKPLPNPRSRRLMPVFSSKNLYSFSSHNGLLIHFEYIFIYDVMYGVQLHSFACGSPLVPLLIIEKISFLHGIVLASLLKASASYWIFFPGTWCRWEAYLFFFLLSLCLVPPVLCCLSTLFLLSPSLPESTVLSPSLSDVPQSSLVHVLAPHTSPWRKVETNDFLFMSHEETESPEKWNNVLRVTIAHSVEGPGPETFSLLRSSPLGCLSSLYPSDVTTKANDGGLNFNSQKCRRLILSSKFQKKMLIKVCYLKCAISRVFHFSGMPWHLLFLPSRGCSYKLIAYERIENNKYQKKVHMVIWYQNISAAKFSSSSLPQGSDELKLQVLFFILLTYRKAIALPTAVQGLSCESGGAGLLSQDSSSQGIPTNLWLLNCSFFLQGTPEGNKTDTCAQATILNWKPKAEFLTLRSSRFLRGICKVEINPFLFTRLSFLDEGTELLNGGIIGLLEEGHGMPVERTGWGGEVEALTWGPKQRSGVALVTFAQTAQSPLHRAINLGKALPAVDWSQPGSQVSKSSIASGAGLSNEDLKIINKSMKYTEKPLRLLSVEQREKVPRRSEGVRKQWMIGRGWGIRCSHCLGCRKRNREPRVRVLDPRPSLSMSLFASLGLYLLLLQIQAWGSLKMAPTCHEMNLRGFPFFPPSKSYKKLDVVAHASNPSILGGRGGRITGRQEFETSLGIVVRLHLCLFENKKSLKIAQQAGDLYVCPSWLYTVPPVLLQCKAACFLTWVRLCPSCLWESALAPNWADYFLRKLMGAPRYSLPARGQTQCRHSLCHWCNVRVYMCTWVPSLAHEFAMSTARSSLSLARCGDDCCSLRIWGKQAPSELDDPLLILCDLLEKWMKLVALAFLDSVSGTGQGPQSRARSLERVSHMTGFTQALPLGLHALCHLTGPGLQVGNVCTLF

SEQ ID NO: 794240 - protein, 74 aa, Homo sapiens
MEKRTAQEKEKYQPSYETTILTEVSRLGAGTEPPRVFHQEQGCWFRFLENRPSRVTTSESAYSVVVGSSVWSSC

SEQ ID NO: 794241 - protein, 235 aa, Homo sapiens
MAERLCECKDGQCGETFSLIPDGIMNKNTLPGVKPCESSVCGEGNVDHSSLNCYIRADTGHKPYECQEHGEKPHKCKQCVKTFSCLHSFQTHEKPHTGEKPYDCKEWEKTFDSPQTVRRYRVVHSGDGPYKCKFCGKAFDNLSLYLTHERSHTGQKPYECNECGKAFGFPSSFHRHERMHTGEKPYECKQCGKTFSCSSSIKKHERIHTGEKPYECKQCGKAFASSNSFQYHERT

SEQ ID NO: 794242 - protein, 184 aa, Homo sapiens
MIFEDVAVNFTQEEWALLDPSQKKLYRDVMWEIIRNLMSVGIKWEDRNIEDQYKNSRRNPRNHMAERLCECKDGQCGETFSLIPDGIMNKNTLPGVKPCESSVCGEGNVDHSSLNCYIRADTGHKPYECQEHGEKPHKCKQCVKTFSCLHSFQTHEKPHTGEKPYDCKECGKAFNCSSSLRKHA

SEQ ID NO: 794243 - protein, 132 aa, Homo sapiens
FWYPSIRPLWPCLEQCLTHSMLQETLARTSNASQDGVIGTQFTPLPRTTVISMTLDIRPQRTVIPKRQETNKVSPMTTPAHCLEESFKSWNRRGNSDGTKAVRIQRAGGREERAGQRELWRSGEGFKGSAEN

SEQ ID NO: 794244 - protein, 119 aa, Homo sapiens
GYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 794245 - protein, 119 aa, Homo sapiens; identical to SEQ ID NO: 794244

SEQ ID NO: 794246 - protein, 156 aa, Homo sapiens
ENWLNLGGGGCSEPRLRHCTPAWEMERDSISKRKERKEGRKEGRKEGRKEGRKEGRKEGRKEGREINLHAVKALDCEGYLLLQSNTTYPDSRMQQNGVEWIRKHSSHIVRLSPGQRTVHRPPFPGSTDAGHRASPLSFGLHQEFRLFQHKSQRLAG

SEQ ID NO: 794247 - protein, 185 aa, Homo sapiens
GCAAGRGRELEPELEPGPGPGSALEPGEEFEIVDRSQLPGPGDLRSATRPRAAEGWSAPILTLARRATGNLSASCGSALRAARGWAAGTAGTARRAQFKCQMMEERANLMHMMKLSIKVLLQSALSLGRSLDADHAPLQQFFVVMEHCLKHGLKVKKSFIGQNKSFFGPLELVEKLCPEASDIAT

SEQ ID NO: 794248 - protein, 118 aa, Homo sapiens
REYCKLTKNQEICLVGDWQKNRGAPSTAGVPSAWGWGDVGPPECLLEKGTGALAGGAVAIFFFFPGDGVLLFPGGVWWHNLGSLQLPPPGFKRFFCLSLLSSWDYRHEPTCPANFLYF

SEQ ID NO: 794249 - protein, 156 aa, Homo sapiens
MSGNFSGCETKEWRGGDIGIKYIEISRCCYTPYNEQNSPHNRERSSPQMLLVLILRNLAIRSLEPIFSDRGSHTEFKMEVFSERHSHSWSPYPSMNSPHLLCSGSFLAFFGPPRRPIPMSWSIVFQGPAQMPPLSIFPQQSQGGQTFLVLPLQSLF

SEQ ID NO: 794250 - protein, 152 aa, Homo sapiens
SLPPLGRRAPVQPAPLGLKFSGLQKLPAWLPPGLGWPGPGRRGVGGNPGEATEIRCAGRFKWNRKPGLGPQTRGSAGTASLLKKTGLGKAARVGPASAVCPPGSGEMARGPDHPPQPAAGLSTATGPREGRERGVLSRGPGAGLSAQVSVKM

SEQ ID NO: 794251 - protein, 210 aa, Homo sapiens
FYEEWWFLLVMALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGRAPAPHRYEAVAGSEAGAQLHPVITTQSAGGVYTPAGPGARTPLTGFSSFV

SEQ ID NO: 794252 - protein, 300 aa, Homo sapiens
TFQKKIPLSQNSLRMTHRTPKVKKSPKFRKKSYLSRLMLANRPPFSAAKSLINSPSQGAFSSLGDLSPQENPFLEVSAPSEHFIETTNIKDTTARNALEENVFMENTNMPEVTISENTNYNHPPEADSAGTAFNLGPTVKQTETKWEYNNVGTDLSPEPKSFNYSIAQFEIQLTQQLQSLIPNNNVRRLISHVIRTLKMDCSGAHVQVTCAKLISRTGHLMKLLSGQQEVKASEIEWDTDQWKTENYINESTEAQSEQKEKSLELTKEVPGYGYTDKLILALIVTEILMILIILFCLIVV

SEQ ID NO: 794253 - protein, 334 aa, Homo sapiens
TFQKKIPLSQNSLRMTHRTPKVKKSPKFRKKSYLSRLMLANRPPFSAAKSLINSPSQGAFSSLGDLSPQENPFLEVSAPSEHFIETTNIKDTTARNALEENVFMENTNMPEVTISENTNYNHPPEADSAGTAFNLGPTVKQTETKWEYNNVGTDLSPEPKSFNYSIAQFEIQLTQQLQSLIPNNNVRRLISHVIRTLKMDCSGAHVQVTCAKLISRTGHLMKLLSGQQEVKASEIEWDTDQWKTENYINESTEAQSEQKEKSLELTKEVPGYGYTDKLILALIVTEILMILIILFCLIVVRTIINSGFQNAVLFLCGFRAHKLKTKATFPPAAT

SEQ ID NO: 794254 - protein, 124 aa, Homo sapiens
MLLPFIKLPTTGNSLAKIQTVGQNRQKVNRVLMGPMSIQKRHFKEVGRQSIRREQGAQASVENAAEEKRLGSPAPRELEQPHTQQGPEKLAGNAIYTKPSFSQEHKAAVSVLTPFSKGAPSTSS

SEQ ID NO: 794255 - protein, 359 aa, Homo sapiens
TFQKKIPLSQNSLRMTHRTPKVKKSPKFRKKSYLSRLMLANRPPFSAAKSLINSPSQGAFSSLGDLSPQENPFLEVSAPSEHFIETTNIKDTTARNALEENVFMENTNMPEVTISENTNYNHPPEADSAGTAFNLGPTVKQTETKWEYNNVGTDLSPEPKSFNYSIAQFEIQLTQQLQSLIPNNNVRRLISHVIRTLKMDCSGAHVQVTCAKLISRTGHLMKLLSGQQEVKASEIEWDTDQWKTENYINESTEAQSEQKEKSLELTKEVPGYGYTDKLILALIVTEILMILIILFCLIVMCCHRRSLQEDEEGFSRGIFRFLPRRRCSSRRESQVHWRIHCCGQGRQRTCKISISLSIF

SEQ ID NO: 794256 - protein, 381 aa, Homo sapiens
TFQKKIPLSQNSLRMTHRTPKVKKSPKFRKKSYLSRLMLANRPPFSAAKSLINSPSQGAFSSLGDLSPQENPFLEVSAPSEHFIETTNIKDTTARNALEENVFMENTNMPEVTISENTNYNHPPEADSAGTAFNLGPTVKQTETKWEYNNVGTDLSPEPKSFNYSIAQFEIQLTQQLQSLIPNNNVRRLISHVIRTLKMDCSGAHVQVTCAKLISRTGHLMKLLSGQQEVKASEIEWDTDQWKTENYINESTEAQSEQKEKSLELTKEVPGYGYTDKLILALIVTEILMILIILFCLIVMCCHRRSLQEDEEGFSRGIFRFLPRRRCSSRRESQDGLFSFRRPLWLKDMYKPLSATRVNNHAWKLHKKSSNEDEILNRDPG

SEQ ID NO: 794257 - protein, 324 aa, Homo sapiens
TFQKKIPLSQNSLRMTHRTPKVKKSPKFRKKSYLSRLMLANRPPFSAAKSLINSPSQGAFSSLGDLSPQENPFLEVSAPSEHFIETTNIKDTTARNALEENVFMENTNMPEVTISENTNYNHPPEADSAGTAFNLGPTVKQTETKWEYNNVGTDLSPEPKSFNYSIAQFEIQLTQQLQSLIPNNNVRRLISHVIRTLKMDCSGAHVQVTCAKLISRTGHLMKLLSGQQEVKASEIEWDTDQWKTENYINESTEAQSEQKEKSLEMCCHRRSLQEDEEGFSRGIFRFLPRRRCSSRRESQVHWRIHCCGQGRQRTCKISISLSIF

SEQ ID NO: 794258 - protein, 397 aa, Homo sapiens
TFQKKIPLSQNSLRMTHRTPKVKKSPKFRKKSYLSRLMLANRPPFSAAKSLINSPSQGAFSSLGDLSPQENPFLEVSAPSEHFIETTNIKDTTARNALEENVFMENTNMPEVTISENTNYNHPPEADSAGTAFNLGPTVKQTETKWEYNNVGTDLSPEPKSFNYSIAQFEIQLTQQLQSLIPNNNVRRLISHVIRTLKMDCSGAHVQVTCAKLISRTGHLMKLLSGQQEVKASEIEWDTDQWKTENYINESTEAQSEQKEKSLELTKEVPGYGYTDKLILALIVTEILMILIILFCLIVMCCHRRSLQEDEEGFSRGIFRFLPRRRCSSRRESQDGLFSFRRPLWLKDMYKPLSATRVNNHAWKLHKKSSNEDEILNRDPGDSEAPTEKGEESEALP

SEQ ID NO: 794259 - protein, 31 aa, Homo sapiens
LGVLIILLSTMVTSITGLSTSAIATNGFVRG

SEQ ID NO: 794260 - protein, 111 aa, Homo sapiens
APSPSSPASHQMLPPFLSSEAWLLLALCGLPCLLLSRHSGSPRGSLFDPTRADFVCGWQCTPRRGGEVPGPRCGREGAVQSKRLQRALAQQSWLDPSSDPSALKARVTEPS

SEQ ID NO: 794261 - protein, 81 aa, Homo sapiens
MSYYGSYYGGLGYGCGGFGGLGYGYGCGCGSFRRLGSGCGYGGYGYGSGFGGYGYGSGFGGYGYGCYRPSYYGGYGFSGFY

SEQ ID NO: 794262 - protein, 171 aa, Homo sapiens
MEPGPALAWLLLLSLLADCLKAAQSRDFTVKDIIYLHPSTTPYPGGFKCFTCEKAADNYECNRWAPDIYCPRETRYCYTQHTMEVTGNSISVTKRCVPLEECLSTGCRDSEHEGHKVCTSCCEGNICNLPLPRNETDATFATTSPINQTNGHPRCMSVIVSCLWLWLGLML

SEQ ID NO: 794263 - protein, 129 aa, Homo sapiens
MHIKNNLLEQSQARERRGFRAPAKQWEKTYPYLFLLIFKGTVNISRRKTPSLPLRNLQSYGRDTDGSAQLPNIIKKPEKKLCKSYCVSTEAVNLILSCRVSNKALFWKQRTALTRHGICWCPDLGIPTV

SEQ ID NO: 794264 - protein, 171 aa, Homo sapiens; identical to SEQ ID NO: 794262

SEQ ID NO: 794265 - protein, 127 aa, Homo sapiens
MEPGPALAWLLLLSLLADCLKAAQSRDFTVKDIIYLHPSTTPYPGGFKCFTCEKAADNYECNRWAPDIYCPRETRYCYTQHTMEVTGNSISVTKRCVPLEECLSTGCRDSEHEGHKVWATEQVTSTT

SEQ ID NO: 794266 - protein, 103 aa, Homo sapiens
MEDGNIRRWCRRGCVGECCAAEEPRVCSGGSKAALGGLERSHMQRQSRDMATEAERGLEALPQGAGELEMLLDRGVLGLDLRCTGITMETLRRIIIKPATPSI

SEQ ID NO: 794267 - protein, 139 aa, Homo sapiens
SSLMYVLPFPLLFPSCFVLLPTTCFHPFLFFHSLFCFFPLNSFLGFLLVFLSAYFPTIFSYFLGSPEAFLLLPPSTSSGDELHTPTPIAAVAPRPPKGPSARPPSPSCALVSVYLCVFGGVGIGPPFSQWRKVCCAPPL

SEQ ID NO: 794268 - protein, 1017 aa, Homo sapiens
MPVMKGLLAPQNTFLDTIATRFDGTHSNFLLANAQGTRGFPIVYCSDGFCELTGYGRTEVMQKTCSCRFLYGPETSEPALQRLHKALEGHQEHRAEICFYRKDGSAFWCLLDMMPIKNEMGEVVLFLFSFKDITQSGSPGLGPQGGRGDSNHENSLGRRGATWKFRSARRRSRTVLHRLTGHFGRRGQGGMKANNNVFEPKPSVPEYKVASVGGSRCLLLHYSVSKAIWDGLILLATFYVAVTVPYNVCFSGDDDTPITSRHTLVSDIAVEMLFILDIILNFRTTYVSQSGQVISAPRSIGLHYLATWFFIDLIAALPFDLLYIFNITVTSLVHLLKTVRLLRLLRLLQKLERYSQCSAVVLTLLMSVFALLAHWMACIWYVIGRREMEANDPLLWDIGWLHELGKRLEVPYVNGSVGGPSRRSAYIAALYFTLSSLTSVGFGNVCANTDAEKIFSICTMLIGALMHAVVFGNVTAIIQRMYSRRSLYHSRMKDLKDFIRVHRLPRPLKQRMLEYFQTTWAVNSGIDANELLRDFPDELRADIAMHLNREILQLPLFGAASRGCLRALSLHIKTSFCAPGEYLLRRGDALQAHYYVCSGSLEVLRDNMVLAILGKGDLIGADIPEPGQEPGLGADPNFVLKTSADVKALTYCGLQQLSSRGLAEVLRLYPEYGAAFRAGLPRDLTFNLRQGSDTSGLSRFSRSPRLSQPRSESLGSSSDKTLPSITEAESGAEPGGGPRPRRPLLLPNLSPARPRGSLVSLLGEELPPFSALVSSPSLSPSLSPALAGQGHSASPHGPPRCSAAWKPPQLLIPPLGTFGPPDLSPRIVDGIEDSGSTAEAPSFRFSRRPELPRPRSQAPPTGTRPSPELASEAEEVKEKVCRLNQEISRLNQEVSQLSRELRHIMGLLQARLGPPGHPAGSAWTPDPPCPQLRPPCLSPCASRPPPSLQDTTLAEVHCPASVGTMETGTALLDLRPSILPPYPSEPDPLGPSPVPEASPPTPSLLRHSFQSRSDTFH

SEQ ID NO: 794269 - protein, 70 aa, Homo sapiens
DALPIPGFHLRRMQGFLLELKTHWLLESPRSPPPPADLAVTVLACGAEGLPSSGATRDRQDGVGSGPSVC

SEQ ID NO: 794270 - protein, 69 aa, Homo sapiens
ALLPLSCRLLHRPHFRHNTKEQGFLLEGADPGINRTDDVALLKELTLQREGTNSEDKFRSVFPLPAHIH

SEQ ID NO: 794271 - protein, 37 aa, Homo sapiens
MLGSHRPGAPDSELLTVIFHDAFACAVLVCWALESGA

SEQ ID NO: 794272 - protein, 68 aa, Homo sapiens
GHAEGSILSTPPGAVCSAGTLTPVTPRVHSGSGPQGCNTLYWLQGGGQHGVEEGEADLDHCPQESSKK

SEQ ID NO: 794273 - protein, 115 aa, Homo sapiens
FRCDVCFELSPCARLKSRRQNYRKIPAGERRERRVSSGAGGAPALGTWGRKTRPNTRASAGAKNNPRGPGAHPGATRAHLRGPRHPPRGNGAPTSGARGALPRGSEQLGSEHPPR

SEQ ID NO: 794274 - protein, 108 aa, Homo sapiens
SACRGETVCPPLTSPRERALPGGFQSQLCMIVAVEETRRSCERPPSFTWKISESYGQEKSNRYRHGEERQRKKSCLRDLWSIGGRGEALAAGAVTIECTHTCTNKILM

SEQ ID NO: 794275 - protein, 112 aa, Homo sapiens
SKRPLPSAPPSPAGRPLPGEPREEWAGSSGARRRHPAPKAPGRKGSPDLAVPGPTLESVGGQRPDAPPAAASRKPSLARTVELAGSFQSAYGKLCPILEKLLMGLEIRGGDD

SEQ ID NO: 794276 - protein, 103 aa, Homo sapiens
ASGPFLRPRPAPPAARSLGNRGRNGRGPQVPGDVIQPPRLQDAKGPLIWQSLDLPWRAWGDKGRTRRPLPPPGSPPLPGQWSWPGVDSRKGRREGGVERATPG

SEQ ID NO: 794277 - protein, 75 aa, Homo sapiens
HGQDPLDLASIAPCQPGCQVQTPGLVTAQTVPESPGGSDPRGRQGASQERFKHCSTPKEWCEPRGFIPEDIMANN

SEQ ID NO: 794278 - protein, 573 aa, Homo sapiens
ACRFRLWRGGHVPRPVAPATAAVVLRPRPFSPCDAPTRRSAAVVRSRPRGPPSGRQWMTRGGGGGDTISKMPDVKESVPPKYPGDSEGRSCKPETSGPPQEDKSGSEDPPPFLSVTGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 794279 - protein, 507 aa, Homo sapiens
ACRFRLWRGGHVPRPVAPATAAVVLRPRPFSPCDAPTRRSAAVVRSRPRGPPSGRQWMTRGGGGGDTISKMPDVKESVPPKYPGDSEGRSCKPETSGPPQEDKSGSEDPPPFLSVTGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIAQALETKVESV

SEQ ID NO: 794280 - protein, 441 aa, Homo sapiens
MAPKGILGSFPTAMNLSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 794281 - protein, 490 aa, Homo sapiens
ACRFRLWRGGHVPRPVAPATAAVCSQAPAFLTVRRPNPPLRRGGTLQAARPTERTPVDDPRRGRRSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 794282 - protein, 527 aa, Homo sapiens
ACRFRLWRGGHVPRPVAPATAAVVLRPRPFSPCDAPTRRSAAVVRSRPRGPPSGRQWMTRGGGGGVLSVTGLTETVNEVSKLSNKIGMNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 794283 - protein, 362 aa, Homo sapiens
MDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRTRLQELKSQLHQLTVMASVLLVASSFSGSVLFGSPQFVDKLKRITKSLLEDFHSRPEEAILTVSEQVSQEIHQSLKNMGLVALSSDNTASLMGQLQNIAKKENCVCSVIDQRIHLFLKCCLVLGVQRSLLDLPGGLTLIEAELAELGQKFVNLTHHNQQVFGPYYTEILKTLISPAQALETKVESV

SEQ ID NO: 794284 - protein, 362 aa, Homo sapiens; identical to SEQ ID NO: 794283

SEQ ID NO: 794285 - protein, 91 aa, Homo sapiens
SLPLPALAGGARAPSRCPGDRGGCSQAPAFLTVRRPNPPLRRGGTLQAARPTERTPVDDPRRGRRRYHQQNARRQGECAPEISWRLRGQVL

SEQ ID NO: 794286 - protein, 441 aa, Homo sapiens; identical to SEQ ID NO: 794280

SEQ ID NO: 794287 - protein, 362 aa, Homo sapiens; identical to SEQ ID NO: 794283

SEQ ID NO: 794288 - protein, 218 aa, Homo sapiens
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRMSLLSPKLECNGTI

SEQ ID NO: 794289 - protein, 404 aa, Homo sapiens
MIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVI

SEQ ID NO: 794290 - protein, 716 aa, Homo sapiens
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVI

SEQ ID NO: 794291 - protein, 665 aa, Homo sapiens
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVI

SEQ ID NO: 794292 - protein, 346 aa, Homo sapiens
SPQPGMLLRPRRPPPLAPPAPPSPASPDPEPRTPGDAPGTPPRRPASPSALGELGLPVSPGSAQRTPWSARETELLLGTLLQPAVWRALLLDRRQALPTYRRVSAALAQQQVRRTPAQCRRRYKFLKDKFREAHGQPPGPFDEQIRKLMGLLGDNGRKRPRRRSPGSGRPQRARRPVPNAHAPAPSEPDATPLPTARDRDAEPHLELRFSPSPPKSADASRARGSPPAPAPTALATCIPEDRAPVRGPGSPPPPPAREDPDSPPGRPEDCAPPPAAPPSLNTALLQTLGHLGDIANILGPLRDQLLTLNQHVEQLRGAFDQTVSLAVGFILGSAAAERGVLRDPCQ

SEQ ID NO: 794293 - protein, 2041 aa, Homo sapiens
MVVSAGPWSSEKAEMNILEINEKLRPQLAENKQQFRNLKERCFLTQLAGFLANRQKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQQLVQKLSPENDEDEDEDVQVEEDEKVLESSAPREVQKAEESKVPEDSLEECAITCSNSHGPCDSNQPHKNIKITFEEDKVNSTVVVDRKSSHDECQDALNILPVPGPTSSATNVSMVVSAGPLSSEKAEMNILEINEKLRPQLAEKKQQFRSLKEKCFVTQLAGFLAKQQNKYKYEECKDLIKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSSPREMQKAEESKVPEDSLEECAITCSNSHGPCDSNQPHKNIKITFEEDKVNSSLVVDRESSHDECQDALNILPVPGPTSSATNVSMVVSAGPLSSEKAEMNILEINEKLRPQLAEKKQQFRSLKEKCFVTQVACFLAKQQNKYKYEECKDLIKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEVIRLSQFLLKGHRWDQVKKEDQEATGPRLSRELLAEKEPEVLQDSLDRCYSTPSVYLGLTDSCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRCYSTPSGYLELPDLGQPYRSAAYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRR

SEQ ID NO: 794294 - protein, 77 aa, Homo sapiens
IKNFILERNFTNVKNVTKFTFANHTLKDIGGFIQERNLTSVVIVVKPLIHLHTLLGIRESILDRNLTNVISVARSLV

SEQ ID NO: 794295 - protein, 421 aa, Homo sapiens
MGRPTQWPSLLLLLLLPGPPPVAGLEDAAFPHLGESLQPLPRACPLRCSCPRVDTVDCDGLDLRVFPDNITRAAQHLSLQNNQLQELPYNELSRLSGLRTLNLHNNLISSEGLPDEAFESLTQLQHLCVAHNKNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQVRHRLVSHTVPRAPPSPCLPCHVPNILVSW

SEQ ID NO: 794296 - protein, 67 aa, Homo sapiens
RDTEAHSWHTPGSQTTPAWRDTPYPKLPTQMEAATIKPNPSSTQHGPGTLWGLCPRTPPHNQSSWGN

SEQ ID NO: 794297 - protein, 411 aa, Homo sapiens
MEIFPLTFGEKPALRSVYLHNNQLSNAGLPPDAFRGSEAIATLSLSNNQLSYLPPSLPPSLERLHLQNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQMLDLSHNELSFVPPDLPEALEELHLEGNRIGHVGPEAFLSTPRLRALFLRANRLHMTSIAAEAFLGLPNLRVVDTAGNPEQVLIRL

SEQ ID NO: 794298 - protein, 537 aa, Homo sapiens
KLPASRRRRSPCPQRHSLAPVTAHLQEIHISALQSSQTDGGERHHPPALGVSSLMEETEPASVTLTLRGKTQPYPGSSHTFNGEAHPVAEPAAAPAVAGAPARRRLGRRCLPPPGGELAAPAPGLSPALLLAPESTLWTVMAWTFECSRTTSPEPLSTSPCRTTSSRNSPTMSCPASVACEPSTSTTTSSPPKNNLISKVPRGALSRQTQLRELYLQHNQLTDSGLDATTFSKLHSLEYLDLSHNQLTTVPAGLPRTLAILHLGRNRIRQVEAARLHGARGLRYLLLQHNQLGSSGLPAGALRPLRGLHTLHLYGNGLDRVPPALPRRLRALVLPHNHVAALGARDLVATPGLTELNLAYNRLASARVHHRAFRRLRALRSLDLAGNQLTRLPMGLPTGLRTLQLQRNQLRMLEPEPLAGLDQLRELSLAHNRLRVGDIGPGTWHELQALQMLDLSHNELSFVPPDLPEALEELHLEGNRIGHVGPEAFLSTPRLRALFLRANRLHMTSIAAEAFLGLPNLRVVDTAGNPEQVLIRL

SEQ ID NO: 794299 - protein, 133 aa, Homo sapiens
MGRPTQWPSLLLLLLLPGPPPVAGLEDAAFPHLGESLQPLPRACPLRCSCPRVDTVDCDGLDLRVFPDNITRAAQHLSLQTTPAWRDTPYPKLPTQMEAATIKPNPSSTQHGPGTLWGLCPRTPPHNQSSWGN

SEQ ID NO: 794300 - protein, 40 aa, Homo sapiens
MTASLCRANRLHMTSIAAEAFLGLPNLRVVDTAGNPEQVL

SEQ ID NO: 794301 - protein, 766 aa, Homo sapiens
MLKMLQRCEDSRAKKRPQLLRALARVPSPVRNRALGWSWSTASNSNRSTPACSPILRKRSRSPTPQNQDGDTMVEKGSDHSSDKSPSTPEQGVQRSCSSQSGRSGGKNSKKSQSWYNVLSPTYKQRNEDFRKLFKQLPDTERLIVDYSCALQRDILLQGRLYLSENWICFYSNIFRWETLLTVRLKDICSMTKEKTARLIPNAIQVCTDSEKHFFTSFGARDRTYMMMFRLWQNALLEKPLCPKELWHFVHQCYGNELGLTSDDEDYVPPDDDFNTMGYCEEIPVEENEVNDSSSKSSIETKPDASPQLPKKSITNSTLTSTGSSEAPVSFDGLPLEEEALEGDGSLEKELAIDNIMGEKIEMIAPVNSPSLDFNDNEDIPTELSDSSDTHDEGEVQAFYEDLSGRQYVNEVFNFSVDKLYDLLFTNSPFQRDFMEQRRFSDIIFHPWKKEENGNQSRVILYTITLTNPLAPKTATVRETQTMYKASQESECYVIDAEVLTHDVPYHDYFYTINRYTLTRVARNKSRLRVSTELRYRKQPWGLVKTFIEKNFWSGLEDYFRHLESELAKTESTYLAEMHRQSPKEKASKTTTVRRRKRPHAHLRVPHLEEVMSPVTTPTDEDVGHRIKHVAGSTQTRHIPEDTPNGFHLQSVSKLLLVISCVLVLLVILNMMLFYKLWMLEYTTQTLTAWQGLRLQERLPQSQTEWAQLLESQQKYHDTELQKWREIIKSSVMLLDQMKDSLINLQNGIRSRDYTSESEEKRNRYH

SEQ ID NO: 794302 - protein, 359 aa, Homo sapiens
MTSTSKGILRPFLIVCIILGCFMACLLIYIKPTNSWIFSPMESASSVLKMKNFFSTKTDYFNETTILVWVWPFGQTFDLTSCQAMFNIQGCHLTTDRSLYNKSHAVLIHHRDISWDLTNLPQQARPPFQKWIWMNLESPTHTPQKSGIEHLFNLTLTYRRDSDIQVPYGFLTVSTNPFVFEVPSKEKLVCWVVSNWNPEHARVKYYNELSKSIEIHTYGQAFGEYVNDKNLIPTISACKFYLSFENSIHKDYITEKLYNAFLAGSVPVVLGPSRENYENYIPADSFIHVEDYNSPSELAKYLKEVDKNNKLYLSYFNWRKDFTVNLPRFWESHACLACDHVKRHQEYKSVGNLEKWFWN

SEQ ID NO: 794303 - protein, 73 aa, Homo sapiens
SFSEAGDGQRARAAQQLQIHCSPLQLPAPPPLSLPRCPPAPVALLGQRRHRRLALPASCAAQPSRAPRMALYP

SEQ ID NO: 794304 - protein, 359 aa, Homo sapiens; identical to SEQ ID NO: 794302

SEQ ID NO: 794305 - protein, 359 aa, Homo sapiens; identical to SEQ ID NO: 794302

SEQ ID NO: 794306 - protein, 81 aa, Homo sapiens
PRKCFLMLTLEICSNQGDFPICQNFKIHLMTVLLSPERDKELGHVVMKFEKSQDLQVGDRGELMMCCGMSPKDRALGEPMV

SEQ ID NO: 794307 - protein, 2768 aa, Homo sapiens
EEAGDLVQPGISFPGPAEEDLDPQYSWSPTQHFNEERYSPAPRSMKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESGGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRLWGRRPAPSPRRFRFPGRLCSAAPPWWFLSPPPAEHVLAPALPAPRTQRDAAGGLRVHGARGEDDFCFCCCCCCSRVAWLTLGSEGQVWRDLISPACSQRTARNASGAGTQLTFCYFYFYKLCDELEVRITNYKRVHPTTPWRHETPKWKVLQPEAQERKAHSPRTAELLLPEHGPLRSPAPVCLGQKTRGSLCQASCDGKRPLQPPHSPPYSSPESQAMTSLNPRKYPAQHLHIQKKAECSHQEVTRREESLTEGWELKKENNVLTCKQLLYFLFLSNLKYDTQYFLEVSPFTLHVIFLMYVYIYILKLLYQLTFQGILKKKHTRKTKVCLFENDSCDVKSLRNMNVSGKYISVEMVKKKCSLHLYFSRILLSYAVLLKSRIYSLPVLDMKGKRGHILGFPAVAFKKKIGVHDSVVWCQRKIGTTLINRLSVYIIKFSCCNHCSDIDFCFTVQTGLQRKSLSDFSMGSSFRVLIITQSKSGLRFKMFPPQYLVFLPGLRSTMYLATGRIAFDDPIALCFFTLFALYNVPSPSAARGWQGVRCAVGPQRALQCGVSLPHSPHPTEHGTIGSRADIKACLASKFYFFKAEELRIPCKNKTLEIEPHVWYIFYQTALKYIWKQKSVRMYLLEKCKKKKNPGISSIMNPNPPRVFKAFFLTNEYLNLEECTVMTLLPYIHSYYVKTNVFAEYWHFRTLKMLYDFQVNLLFRSNHRKAKSVYTLSERKCNVDKGPPPPHIGAIYWQLIRLTHFLELIQNIEKQTVKVVNNYLSQIPEFYDPCLKENVHCMEVDFLCFVDSLLFFNPQKSWPKPSLGEQINLPIHCTGLVTRRGECAHALPGPPCSKEDDLMVERIPAARPDGMLPVRVTESSAIYSVLMQVTFYHETQKISHVSVLYMERKIKLFMILVLVTRASLFQPLLADHAMELTTCDHFVIFKIELQEKSKHPLENTAENYCAVLENIILESVMFTITPYLHSLMIQPMTGETQTLSFRADRLILLCGRLWLIKHKYDKQDLAFSPGKENAACHLECFPCDASLASSRVVVFEVKLVVIDDNFYHEFSQQIYITILEVVYKKIELFMIPKKLQFCLKGNVDVFNSKSILKTSSTEWKGKWSDKNIITCKVYLVLKEKKKAYKLSDLLRRGNFSLLLLMKVARFIIRRHSGRAHMCTGSDYFSWSICPCLDFCLFDAILSSHRFHPFALEGPASVNSRISVFVEILVSIATRVQDGISQESEGILQACVCSACGNCGMSSVRDSCLVCAKPSRGEEGVGEVGPSLPSGRPFLSAAIPSSQASCGPEHEGARGPPGRCSFCFRCVSSVSLAWNSGRFPGVFQWTGGPRAVAESAWVPQSPAGPPLMTGPPTNLGKAAGNVGEGVRWYGHKSIVQNSAGSGRAPGYCLWPTLKTEIAPPVSTETRFSNTGRNNYNSTWFLPAHFPALFFSSLNFIFFFSCKFNRLIENCSFQTTAPGNVPGFSCFDLHVCLHFSVGVGVNTSFQNFKIENHELKGEKDDPFLIRICNSVGWVNAVCFIQGHVAAMTPPHKVSSEPMASLQEPHLVAISWELQYIVGHKQSAKGKGLLLHIRLNVPQCRVAAECSGNEGDIARNLWLLGNLAFIHPQPATHLKFMSQFFSSRKGITVPVPVFLQDTAVRINDILALKSFELLGTGGESVRYCKGLVLALLECRPPSSAGHAARIQAGRKHLRDNQGPPEAEAMRLSLERFGNAEITTRAILLSFWLSTVSRCFQEQEPSTNQN

SEQ ID NO: 794308 - protein, 2762 aa, Homo sapiens
FSGLNSRTFRGLAEEDLDPQYSWSPTQHFNEERYSPAPRSMKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESGGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRLWGRRPAPSPRRFRFPGRLCSAAPPWWFLSPPPAEHVLAPALPAPRTQRDAAGGLRVHGARGEDDFCFCCCCCCSRVAWLTLGSEGQVWRDLISPACSQRTARNASGAGTQLTFCYFYFYKLCDELEVRITNYKRVHPTIPGGIRHPSGRCYNLKRRKERPIPLAQPSFYSLSTGRSAPLLLSVSDRKHEAPCVKLPVMESDLSNHHIPAVQFSRIPGDDKSEPTKIPSAASTHSKDKLSVPTRKSRAERRVLRRAGSLKENNVLTCKQLLYFLFLSNLKYDTQYFLEVSPFTLHVIFLMYVYIYILKLLYQLTFQGILKKKHTRKTKVCLFENDSCDVKSLRNMNVSGKYISVEMVKKKCSLHLYFSRILLSYAVLLKSRIYSLPVLDMKGKRGHILCFPAVAFKKKIGVHDSVVWCQRKIGTTLINRLSVYIIKFSCCNHCSDIDFCFTVQTGLQRKSLSDFSMGSSFRVLIITQSKSGLRFKMFPPQYLVFLPGLRSTMYLATGRIAFDDPIALCFFTLFALYNVPSPSAARGWQGVRCAVGPQRALQCGVSLPHSPHPTEHGTIGSRADIKACLASKFYFFKAEELRIPCKNKTLEIEPHVWYIFYQTALKYIWKQKSVRMYLLEKCKKKKNPGISSIMNPNPPRVFKAFFLTNEYLNLEECTVMTLLPYIHSYYVKTNVFAEYWHFRTLKMLYDFQVTLLFRSNHRKAKSVYTLSERKCNVDKGPPPPHIGAIYWQLIRLTHFLELIQNIEKQTVKVVNNYLSQIPEFYDPCLKENVHCMEVDFLCFVDSLLFFNPQKSWPKPSLGEQINLPIHCTGLVTRRGECAHALPGPPCSKEDDLMVERIPAARPDGMLPVRVTESSAIYSVLMQVTFYHETQKISHVSVLYMERKIKLFMILVLVTRASLFQPLLADHAMELTTCDHFVIFKIELQEKSKHPLENTAENYCAVLENIILESVMFTITPYLHSLMIQPMTGETQTLSFRADRLILLCCRLWLIKHKYDKQDLAFSPGKENAACHLECFPCDASLASSRVVVFEVKLVVIDDNFYHSFLSKFISPSRMVYKKIELFMIPKKLQFCLKGNVDVFNSKSILKTSSTEWKGKWSDKNIITCKVYLVLKEKKKAYKLSDLLRRGNFSLLLLMKVARFIIRRHSGRAHMCTGSDYFSWSICPCLDFCLFDAILSSHRFHPFALEGPASVNSRISVFVEILVSIATRVQDGISQESEGILQACVCSACGNCGMSSVRDSCLVCAKPSRGEEGVGEVGPSLPSGRPFLSAAIPSSQASCGPEHEGARGPPGRCSFCFRCVSSVSLAWNSGRFPGVFQWTGGPRAVAESAWVPQSPAGPPLMTGPPTNLGKAAGNVGEGVRWYGHKSIVQNSAGSGRAPGYCLWPTLKTEIAPPVSTETRFSNTGRNNYNSTWFLPAHFPALFFSSLNFIFFFSCKFNRLIENCSFQTTAPGNVPGFSCFDLHVCLHFSVGVGVNTSFQNFKIENHELKGEKDDPFLIRICNSVGWVNAVCFIQGHVAAMTPPHKVSSEPMASLQEPHLVAISWELQYIVGHKQSAKGKGLLLHIRLNVPQCRVAAECSGNEGDIARNLWLLGNLAFIHPQPATHLKFMSQFFSSRKGITVPVPVFLQDTAVRINDILALKSFELLGTGGESVRYCKGLVLALLECRPPSSAGHAARIQAGRKHLRDNQGPPEAEAMRLSLERFGNAEITTRAILLSFWLSTVSRCFQEQEPSTNQN

SEQ ID NO: 794309 - protein, 2749 aa, Homo sapiens
FSGLNSRTFRGLAEEDLDPQYSWSPTQHFNEERYSPAPRSMKGLSGSRTQPPLCSGHTCGLAPPEDCEHLHHGPDARPPYLLSPADSCPGGRHRCSPRSSVHSECVMMPVVLGDHVSSSTFPRMHYSSHYDTRDDCAVAHAGAKINRIPANLLDQFEKQLPLHRDGFHTLQYQRTSAAAEQRSESPGRIRHLVHSVQKLFTKSHSLEGSSKSNANGTKADGRADDHHHAHHAKHSKRSKSKERKPEGKPRPGMSSWWSSDDNLDSDSTYRTPSVLNRHHLGPVAHCYPDALQSPFGDLSLKTSKSNNDVKCSACEGLALTPDAKYLKRSSWSTLTVSQAKEAYRKSSLNLDKPLLHQDAKPALRPCHYLQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQVETATDSDTESGGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRLWGRRPAPSPRRFRFPGRLCSAAPPWWFLSPPPAEHVLAPALPAPRTQRDAAGGLRVHGARGEDDFCFCCCCCCSRVAWLTLGSEGQVWRDLISPACSQRTARNASGAGTQLTFCYFYFYKLCDELEVRITNYKRVHPTTPWRHETPKWKVLQPEAQERKAHSPRTAELLLPEHGPLRSPAPVCLGQKTRGSLCQASCDGKRPLQPPHSPPYSSPESQAMTSLNPRKYPAQHLHIQKKAECSHQEVTRREESLTEGWELKRKTMSLLVNSYCIFYFFLLKIRHPVFSLSFTIYATCDFFNVCIYIYSQIALQLTFQGILKKKHTRKTKVCLFKMTVDDVKSLRNMNVSGKYISVEMVKKKCSLHLYFSRILLSYAVLLKSRIYSLPVLDMKGKRGHILGFPAVAFKKKIGVHDSVVWCQRKIGTTLINRLSVYIIKFSCCNHCSDTTSVSQFRPVFKGKDLSDFSMGSSFRVLIITQSKSGLRFKMFPPQYLVFLPGLRSTMYLATGRIAFDDPIALCFFTLFALYNVPSPSAARGWQGVRCAVGPQRALQCGVSLPHSPHPTEHGTIGSRADIKACLASKFYFFKAEELRIPCKNKTLEIEPHVWYIFYQTALKYIWKQKSVRMYLLEKCKKKKNPGISSIMNPNPPRVFKAFFLTNEYLNLEECTVMTLLPYIHSYYVKTNVFAEYWHFRTLKMLYDFQVNLLFRSNHRKAKSVYTLSERKCNVDKGPPPPHIGAIYWQLIRLTHFLELIQNIEKQTVKVVNNYLSQIPEFYDPCLKENVHCMEVDFLCFVDSLLFFNPQKSWPKPSLGEQINLPIHCTGLVTRRGECAHALPGPPCSKEDDLMVERIPAARPDGMLPVRVTYSSAIYSVLMQVTFYHETQKISHVSVLYMERKIKLFMILVLVTRASLFQPLLADHAMELTTCDHFVIFKIELQEKSKHPLENTAENYCAVLENIILESVMFTITPYLHSLMIQPMTGETQTLSFRADRLILLCGRLWLIKHKYDKQDLAFSPGKENAACHLECFPCDASLASSRVVVFEVKLVVIDDNFYHEFSQQIYITILEVVYKKIELFMIPKKLQFCLKGNVDVFNSKSILKTSSTYWKGKWSDKNIITCEGYLVLKEKKKAYKLSDLLRRGNFSLLLLMKVARFIIRRHSGRAHMCTGSDYFSWSICPCLDFCLFDAILSSHRFHPFALEGPASVNSRISVFVEILVSIATRVQDGISQESEGILQACVCSACGNCGMSSVRDSCLVCAKPSRGEEGVGEVGPSLPSGRPFLSAAIPSSQASCGPEHEGARGPPGRCSFCFRCVSSVSLAWNSGRFPGVFQWTGGPRAVAESAWVPQSPAGPPLMTGPPTNLGKAAGNVGEGVRWYGHKSIVQNSAGSGRAPGYCLWPTLKTEIAPPVSTETRFSNTGRNNYNSTWFLPAHFPALFFSSLNFIFFFSCKFNRLIENCSFQTTAPGNVPGFSCFDLHVCLHFSVGVGVNTSFQNFKIENHELKGEKDDPFLIRICNSVGWVNAVCFIQGHVAAMTPPHKVSSEPMASLQEPHLVAISWELQYIVGHKQSAKGKGLLLHIRLNVPQCRVAAECSGNEGDIAGISRLLGNLAFIHPQPATHLKFMSQFFSSRKGITVPVPVFLQDTAVRINDILALKSFELLGTGGESVRYCKGLVLALLECRPPSSAGHAARIQAGRKHLRDNQGPPEAEAMRLSLERFGNAEITTRAILLSFWLSTVSRCFQEQEPSTNQN

SEQ ID NO: 794310 - protein, 2398 aa, Homo sapiens
MSVCSQVPQDEWGGYPTGGKDEEIPCRRMRSGSYIKAMGDEESGESDSSPKTSPKSAILPEPLLKSIGQRPLGEHQTQTYLQAASDVPVGHSLDPAANYNSPKFRSRNQSYMRAVSTLSQASCVSQVSEAEINGQFESVCESVFSEVESQAMDALDLPGCFRTRSHSYLRAIQAGYSQDDECIPMMTPSDITSTIRSTAAVSYTNYKKTPPPVPPRTTSKPLISVTAQSSTESTQDAYQDSRAQRMSPWPQDSRGLYNSTDSLDSNKAMNLALETAAAQRHLPESQSSSVRTSDKAILVSKAEELLKSRCSSIGIQDSEFPEHQPYPRSDVETATDSDTESGGLREYHSVGVQVEDEKRHGRFKRSNSVTAAVQADLELEGFPGHITTEDKGLQFGSSFQRHSEPSTPTQYSAVRTVRTQGLFSYREDYRTQVDTSTLPPPDPWLEPAIDTVETGRMSPCRRDGSWFLKLLHAETKRMEGWCKEMEREAEENDLSEEILGKIRSAVGSAQLLMSQKFQQFYWLCQQNMDPSAMPRPTSQDLAGYWDMLQLSIEDVSMKFDELQRLRLNDWKMMESPERKEERKVPPPIPKKPPKGKFPITREKSLDLPDRQRQEARRRLMAAKRAASFRQNSASERADSIEIYIPEAQTRLWGRRPAPSPRRFRFPGRLCSAAPPWWFLSPPPAEHVLAPALPAPRTQRDAAGGLRVHGARGEDDFCFCCCCCCSRVAWLTLGSEGQVWRDLISPACSQRTARNASGAGTQLTFCYFYFYKLCDELEVRITNYKRVHPTTPWRHETPKWKVLQPEAQERKAHSPRTAELLLPEHGPLRSPAPVCLGQKTRGSLCQASCDGKRPLQPPHSPPYSSPESQAMTSLNPRKYPAQHLHIQKKAECSHQEVTRREESLTEGWELKKENNVLTCKQLLYFLFLSNLKYDTQYFLYVSPFTLHVIFLMYVYIYILKLLYQLTFQGILKKKHTRKTKVCLFENDSCDVKSLRNMNVSGEVYLSLNGKEEMKFTFVFFQNSFVLCSIAKVENIFLACVRHEGKKRSHIVISSCSIQKKNWCSGLCGRCQRKIGTTLINRLSVYIIKFSCCNHCSDIDFCFTVQTGLQRKSLSDFSMGSSFRVLIITQSKSGLRFKMFPPQYLVFLPGLRSTMYLATGRIAFDDPIALCFFTLFALYNVPSPSAARGWQGVRCAVGPQRALQCGVSLPHSPHPTEHGTIGSRADIKACLASKFYFFKAEELRIPCKNKTLYIEPHVWYIFYQTALKYIWKQKSVRMYLLEKCKKKKNPGISSIMNPNSPQVFKAFFLTNEYLNLEECTVMTLLPYIHSYYVKTNVFAEYWHFRTLKMLYDFQVNLLFRSNHRKAKSVYTLSERKCNVDKGPPPPHIGAIYWQLIRLTHFLELIQNIEKQTVKVVNNYLSQIPEFYDPCLKENVHCMEVDFLCFVDSLLFFNPQKSWPKPSLGEQINLPIHCTGLVTRRGECAHALPGPPCSKEDDLMVERIPAARPDGMLPVRVTESSAIYSVLMQVTFYHETQKISHVSVLYMERKIKLFMILVLVTRASLFQPLLADHAMELTTCDHFVILKYNFKKRVNIHWRTRLKIIVLFKEHHPRECDVHYNPIPTFPNDTANDRRNPDTLLRADRLILLCGRLWLIKHKYDKQDLAFSPGKENAACHLECFPCDASLASSRVVVFEVKLVVIDDNFYHSFLSKFISPSRMVYKKIELFMIPKKLQFCLKGNVDVFNSKSILKTSSTEWKGKWSDKNIITCEGYLVLKEKKKAYKLSDLLRRGNFSLLLLMKVARFIIRRHSGRAHMCTGSDYFSWSICPCLDFCLFDAILSSHRFHPFALEGPASVNSRISVFVEILVSIATRVQDGISQESEGILQACVCSACGNCGMSSVRDSCLVCAKPSRGEEGVGEVGPSLPSGRPFLSAAIPSSQASCGPEHEGARGPPGRCSFCFRCVSSVSLAWNSGRFPGVFQWTGGPRAVAESAWVPQSPAGPPLMTGPPTNLGKAAGNVSEGVRWYGHKSIVQNSAGSGRAPGYCLWPTLKTEIAPPVSTETRFSNTGRNNYNSTWFLPAHFPALFFSSLNFIFFFSCKFNRLIENCSFQTTAPGNVPGFSCFDLHVCLHFSVGVGVNTSFQNFKIENQSLRGEKDDPFLIRICNSVGWVNAVCFIQGHVAAMTPPHKVSSEPMASLQEPHLVAISWELQYIVGHKQSAKGKGLLLHIRLNVPQCRVAAECSGNEGDIAGISRLLGNLAFIHPQPATHLKFMSQFFSSRKGITVPVPVFLQDTAVRINDILALKSFELLGTGGESVRYCYGLVLALLECRPPSSAGHAARIQAGRKHLRDNQGPPEAEAMRLSLERFGNAEITTRAILLSFWLSTVSRCFQEQEPSTNQN

SEQ ID NO: 794311 - protein, 74 aa, Homo sapiens
GAHSWRLQLLTSLDKPLDSNDQVEIHHWREHSGMASAKTHSEGLQGNFKTCPWPGTVAYAYNPSTLGGRGGWIT

SEQ ID NO: 794312 - protein, 1710 aa, Homo sapiens
TESLKLPGVYEVLFYNETEDCPGMMLWRYPEPRVLTLVRITPVPFNTTEDPDISTADLGDVLQVPCSLEYWDELQKVFVAFREFNLSESKVCELQLPDINLVNDQKKLVSSDLWRIVLNSSQNGADDQSSASESGSQSTCDPLVTPTALAACTRVDSCFTPWFVPSLCVSFQFAHLEFHLCHHLDQLGTAAPQYLQPFVSDRNMPSELEYMIVSFREPHMYLRQWNNGSVCQEIQFLAQADCKLLECRNVTMQSVVKPFSIFGQMAVSSDVVEKLLDCTVIVDSVFVNLGQHVVHSLNTAIQAWQQNKCPEVEELVFSHFVICNDTQETLRFGQVDTDENILLASLHSHQYSWRSHKSPQLLHICIEGWGNWRWSEPFSVDHAGTFIRTIQYRGRTASLIIKVQQLNGVQKQIIICGRQIICSYLSQSIELKVVQHYIGQDGQAVVREHFDCLTAKQKLPSYILENNELTELCVKAKGDEDWSRDVCLESKAPEYSIVIQVPSSNSSIIYVWCTVLTLEPNSQVQQRMIVFSPLFIMRSHLPDPIIIHLEKRSLGLSETQIIPGKGQEKPLQNIEPDLVHHLTFQAREEYDPSDCAVPISTSLIKQIATKVHPGGTVNQILDEFYGPEKSLQPIWPYNKKDSDRNEQLSQWDSPMRVKLSIWKPYVRTLLIELLPWALLINESKWDLWLFEGEKIVLQVPAGKIIIPPNFQEAFQIGIYWANTNTVHKSVAIKLVHNLTSPKWKDGGNGEVVTLDEEAFVDTEIRLGAFPGHQKLCQFCISSMVQQGIQIIQIEDKTTIINNTPYQIFYKPQLSVCNPHSGKEYFRVPDSATFSICPGGEQPAMKSSSLPCWDLMPDISQSVLDASLLQKQIMLGFSPAPGADSSQCWSLPAIVRPEFPRQSVAVPLGNFRENGFCTRAIVLTYQEHLGVTYLTLSEDPSPRVIIHNRCPVKMLIKENIKDIPKFEVYCKKIPSECSIHHELYHQISSYPDCKTKDLLPSLLLRVEPLDEVTTEWSDAIDINSQGTQVVFLTGFGYVYVDVVHQCGTVFITVAPEGKAGPILTNTNRAPEKIVTFKMFITQLSLAVFDDLTHHKASAELLRLTLDNIFLCVAPGAGPLPGEEPVAALFELYCVEICCGDLQLDNQLYNKSNFHFAVLVCQGEKAEPIQCSKMQSLLISNKELEEYKEKCFIKLCITLNEGKSILCDINEFSFELKPARLYVEDTFVYYIKTLFDTYLPNSRLAGHSTHLSGGKQVLPMQVTQHARALVNPVKLRKLVIQPVNLLVSIHASLKLYIASDHTPLSFSVFERGPIFTTARQLVHALAMHYAAGALFRAGWVVGSLDILGSPASLVRSIGNGVADFFRLPYEGLTRGPGAFVSGVSRGTTSFVKHISKGTLTSITNLATSLARNMDRLSLDEEHYNRQEEWRRQLPESLGEGLRQGLSRLGISLLGAIAGIVDQPMQNFQKTSEAQASAGHKAKGVISGVGKGIMGVFTKPIGGAAELVSQTGYGILHGAGLSQLPKQRHQPSDLHADQAPNSHVKYVWKMLQSLGRPEVHMALDVVLVRGSGQEHEGCLLLTSEVLFVVSVSEDTQQQAFPVTEIDCAQDSKQNNLLTVQLKQPRVACDVEVDGVRERLSEQQYNRLVDYITKTSCHLAPSCSSMQIPCPVVAAEPPPSTVKTYHYLVDPHFAQVFLSKFTMVKNKALRKGFP

SEQ ID NO: 794313 - protein, 1649 aa, Homo sapiens
TESLKLPGVYEVLFYNETEDCPGMMLWRYPEPRVLTLVRITPVPFNTTEDPDISTADLGDVLQVPCSLEYWDELQKVFVAFREFNLSESKVCELQLPDINLVNDQKKLVSSDLWRIVLNSSQNGADDQSCTTVPTAFVSDRNMPSELEYMIVSFREPHMYLRQWNNGSVCQEIQFLAQADCKLLECRNVTMQSVVKPFSIFGQMAVSSDVVEKLLDCTVIVDSVFVNLGQHVVHSLNTAIQAWQQNKCPEVEELVFSHFVICNDTQETLRFGQVDTDENILLASLHSHQYSWRSHKSPQLLHICIEGWGNWRWSEPFSVDHAGTFIRTIQYRGRTASLIIKVQQLNGVQKQIIICGRQIICSYLSQSIELKVVQHYIGQDGQAVVREHFDCLTAKQKLPSYILENNELTELCVKAKGDEDWSRDVCLESKAPEYSIVIQVPSSNSSIIYVWCTVLTLEPNSQVQQRMIVFSPLFIMRSHLPDPIIIHLEKRSLGLSETQIIPGKGQEKPLQNIEPDLVHHLTFQAREEYDPSDCAVPISTSLIKQIATKVHPGGTVNQILDEFYGPEKSLQPIWPYNKKDSDRNEQLSQWDSPMRVKLSIWKPYVRTLLIELLPWALLINESKWDLWLFEGEKIVLQVPAGKIIIPPNFQEAFQIGIYWANTNTVHKSVAIKLVHNLTSPKWKDGGNGEVVTLDEEAFVDTEIRLGAFPGHQKLCQFCISSMVQQGIQIIQIEDKTTIINNTPYQIFYKPQLSVCNPHSGKEYFRVPDSATFSICPGGEQPAMKSSSLPCWDLMPDISQSVLDASLLQKQIMLGFSPAPGADSSQCWSLPAIVRPEFPRQSVAVPLGNFRENGFCTRAIVLTYQEHLGVTYLTLSEDPSPRVIIHNRCPVKMLIKENIKDIPKFEVYCKKIPSECSIHHELYHQISSYPDCKTKDLLPSLLLRVEPLDEVTTEWSDAIDINSQGTQVVFLTGFGYVYVDVVHQCGTVFITVAPEGKAGPILTNTNRAPEKIVTFKMFITQLSLAVFDDLTHHKASAELLRLTLDNIFLCVAPGAGPLPGEEPVAALFELYCVEICCGDLQLDNQLYNKSNFHFAVLVCQGEKAEPIQCSKMQSLLISNKELEEYKEKCFIKLCITLNEGKSILCDINEFSFELKPARLYVEDTFVYYIKTLFDTYLPNSRLAGHSTHLSGGKQVLPMQVTQHARALVNPVKLRKLVIQPVNLLVSIHASLKLYIASDHTPLSFSVFERGPIFTTARQLVHALAMHYAAGALFRAGWVVGSLDILGSPASLVRSIGNGVADFFRLPYEGLTRGPGAFVSGVSRGTTSFVKHISKGTLTSITNLATSLARNMDRLSLDEEHYNRQEEWRRQLPESLGEGLRQGLSRLGISLLGAIAGIVDQPMQNFQKTSEAQASAGHKAKGVISGVGKGIMGVFTKPIGGAAELVSQTGYGILHGAGLSQLPKQRHQPSDLHADQAPNSHVKYVWKMLQSLGRPEVHMALDVVLVRGSGQEHEGCLLLTSEVLFVVSVSEDTQQQAFPVTEIDCAQDSKQNNLLTVQLKQPRVACDVEVDGVRERLSEQQYNRLVDYITKTSCHLAPSCSSMQIPCPVVAAEPPPSTVKTYHYLVDPHFAQVFLSKFTMVKNKALRKGFP

SEQ ID NO: 794314 - protein, 108 aa, Homo sapiens
PGVISSRGRYETKRHRELKRLVQGYPAGKGMSGLEPGQPGFRIRIVSCYYCPSVAEGPRGEDLATEAGWRGRGTDRPGRWSYSQDQAFCGLHRVCSQGRPAGLWAEFP

SEQ ID NO: 794315 - protein, 220 aa, Homo sapiens
TSPAMGAARLLPNLTLCLQLLILCCQTQGENHPSPNFNQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 794316 - protein, 111 aa, Homo sapiens
AFMTYECVLWKPLSSAPRVKEKYSPNEKTEKRVQRINSKVLNFPIRVIVWVPYSSDPGRAFGCDSAHKKPERRKYFPTPAGWTLLPSAANTNWLFSTLQSARQWWGFILKP

SEQ ID NO: 794317 - protein, 122 aa, Homo sapiens
YRIALKSGYGKYLGINSDELVVGCSDAIGPKEQWEQVFQNIRSCAERETTKKDDIQEEDKGNVKQCEINYVKKFQSFQDHKLKISKEDSKILKKAQKDGFLHETLLDRHGSDPDIEPLLLLL

SEQ ID NO: 794318 - protein, 981 aa, Homo sapiens
MLRRPAPALAPAARLLLAGLLCGGGVWAARVNKHKPWLEPTYHGIVTENDNTVLLDPPLIALDKDAPLRFAESFEVTVTKEGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMETYEDQHSSEEEEEEEEEEESEDGEEEDDITSAESESSEEEEGEQGDPQNATRQQQLEWDDSTLSY

SEQ ID NO: 794319 - protein, 971 aa, Homo sapiens
MLRRPAPALAPAARLLLAGLLCGGGVWAARVNKHKPWLEPTYHGIVTENDNTVLLDPPLIALDKDAPLRFAGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMETYEDQHSSEEEEEEEEEEESEDGEEEDDITSAESESSEEEEGEQGDPQNATRQQQLEWDDSTLSY

SEQ ID NO: 794320 - protein, 424 aa, Homo sapiens
ITHYRARAAAGQVPRELPAREDPDGCRSPGSLGVSGTMNVSGCPGAGNASQAGGGGGWHPEAVIVPLLFALIFLVGTVGNTLVLAVLLRGGQAVSTTNLFILNLGVADLCFILCCVPFQATIYTLDGWVFGSLLCKAVHFLIFLTMHASSFTLAAVSLDRYLAIRYPLHSRELRTPRNALAAIGLIWGLSLLFSGPYLSYYRQSQLANLTVCHPAWSAPRRRAMDICTFVFSYLLPVLVLGLTYARTLRYLWRAVDPVAAGSGARRAKRKVTRMILIVAALFCLCWMPHHALILCVWFGQFPLTRATYALRILSHLVSYANSCVNPIVYALVSKHFRKGFRTICAGLLGRAPGRASGRVCAAARGTHSGSVLERESSDLLHMSEAAGALRPCPGASQPCILEPCPGPSWQGPKAGDSILTVDVA

SEQ ID NO: 794321 - protein, 114 aa, Homo sapiens
TYHLMIAIFISTSSFIKLSTQVLFRSLNLKLAFKNKIHEPIAHAKQLHSWMARSLFRCLFTHSWFLEQLLCPVLGQQRQETVLTFKLLPGWLCYPRATNRDLPELAFWPQDDVV

SEQ ID NO: 794322 - protein, 117 aa, Homo sapiens
PGGENALGEPLVRSARRSRIPEKEHGRESGQAGPGSRKTAWRRLPAPAGLLSWTRGELASRADPSCRGPRPGTGGSDTPPPAGHLPWVPLNPGGSSLRWRSVRSGTRETPNPACPTS

SEQ ID NO: 794323 - protein, 143 aa, Homo sapiens
DILKAYEDDVLLIDVIQDDPDLFGVSNEGELSFTSEVPKISQEPNVAGEHQSTDSKYMETPVKKEPSDDLRELPVLDCGWIKPDICASNSAESEIKRDPKDVNTSLGEVANETSENETLGDFSEQIKGSDLDEKHRFTDKVIT

SEQ ID NO: 794324 - protein, 454 aa, Homo sapiens
ELWHKDKMSKDLLLGIARIQLSNILSSEKTRFLGSNGEQCWRQTYSESVPVIAAQGSNNRIADLSYTVTLEDYGLVKMREIFISDSSQGVSAVQQKPSSLPPAPCPSEIQTEPRETLEYKAALELEMWKEMQEDIFENQLKQKELAHMQALAEEWKKRDRERESLVKKKVAEYTILEGKLQKTLIDLEKREQQLASVESELQREKKELQSERQRNLQELQDSIRRAKEDCIHQVELERLKIKQLEEDKHRLQQQLNDAENKYKILEKEFQQFKDQQNNKPEIRLQSEINLLTLEKVELERKLESATKSKLHYKQQWGRALKELARLKQREQESQMARLKKQQEELEQMRLRYLAAEEKDTVKTERQELLDIRNELNRLRQQEQKQYQDSTEIASGKKDGPHGSVLEEGLDDYLTRLIEERDTLMRTGVYNHEDRIISELDRQIREILAKSNASN

SEQ ID NO: 794325 - protein, 211 aa, Homo sapiens
IHYPHPHHSLNFTTLRNIYKILEKEFQQFKDQQNNKPEIRLQSEINLLTLEKVELERKLESATKSKLHYKQQWGRALKELARLKQREQESQMARLKKQQEELEQMRLRYLAAEEKDTVKTERQELLDIRNELNRLRQQEQKQYQDSTEIASGKKDGPHGSVLEEGLDDYLTRLIEERDTLMRTGVYNHEDRIISELDRQIREILAKSNASN

SEQ ID NO: 794326 - protein, 209 aa, Homo sapiens
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 794327 - protein, 532 aa, Homo sapiens
MEGDSYHNATTVNGTPVNHQPLERHRLWEVITIAAVTAVVSLITIVGNVLVMISFKVNSQLKTVNNYYLLSLACADLIIGIFSMNLYTTYILMGRWALGSLACDLWLALDYVASNASVMNLLVISFDRYFSITRPLTYRAKRTPKRAGIMIGLAWLISFILWAPAILCWQYLVGKRTVPLDECQIQFLSEPTITFGTAIAAFYIPVSVMTILYCRIYRETEKRTKDLADLQGSDSVTKAEKRKPAHRALFRSCLRCPRPTLAQRERNQASWSSSRRSTSTTGKPSQATGPSANWAKAEQLTTCSSYPSSEDEDKPATDPVLQVVYKSQGKESPGEEFSAEETEETFVKAETEKSDYDTPNYLLSPAAAHRPKSQKCVAYKFRLVVKADGNQETNNGCHKVKIMPCPFPVAKEPSTKGLNPNPSHQMTKRKRVVLVKERKAAQTLSAILLAFIITWTPYNIMVLVSTFCDKCVPVTLWHLGYWLCYVNSTVNPICYALCNRTFRKTFKMLLLCRWKKKKVEEKLYWQGNSKLP

SEQ ID NO: 794328 - protein, 101 aa, Homo sapiens
ALIPKLFQGFNLSGSMESGFTVEQNEVAVRRGKRGHTTFVLSLLGLLRCNLQTVKSTLISIFSKFWQKSTVIQLPPQSPYKCPHATLCSQPTPLLLASGNH

SEQ ID NO: 794329 - protein, 119 aa, Homo sapiens
KCQVELSPLLYHPSPRWEQEARLPGDRGRRGEDVPAFSPEPLWLSLSAQAGDTTGRSPSPSLPSPRRLYGNQWKFHLRMNGLHYHHLCPSLLCSTKGQVHTLSLYANEVSPSSVRVSLS

SEQ ID NO: 794330 - protein, 1331 aa, Homo sapiens
MSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINKTELACNNTVIGSQMQLQLGRVTRVQKHRKILRAARDLALDTLIIEYRGKVMLRQQFEVNGHFFKKPYPFVLFYSKFNGVEMCVDARTFGNDARFIRRSCTPNAEVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEEVDNPEEKPEEEKEEVIDDQENLAHSRRTREDRKVEAIMHAFENLEKRKKRRDQPLEQSNSDVEITTTTSETPVGEETKTEAPESEVSNSVSNVTIPSTPQSVGVNTRRSSQAGDIAAEKLVPKPPPAKPSRPRPKSRISRYRTSSAQRLKRQKQANAQQAELSQAALEEGGSNSLVTPTEAGSLDSSGENRPLTGSDPTVVSITGSHVNRAASKYPKTKKYLVTEWLNDKAEKQECPVECPLRITTDPTVLATTLNMLPGLIHSPLICTTPKHYIRFGSPFIPERRRRPLLPDGTFSSCKKRWIKQALEEGMTQTSSVPQETRTQHLYQSNENSSSSSICKDNADLLSPLKKWKSRYLMEQNVTKLLRPLSPVTPPPPNSGSKSPQLATPGSSHPGEEECRNGYSLMFSPVTSLTTASRCNTPLQFELCHRKDLDLAKVGYLDSNTNSCADRPSLLNSGHSDLAPHPSLGPTSETGFPSRSGDGHQTLVRNSDQAFRTEFNLMYAYSPLNAMPRADGLYRGSPLVGDRKPLHLDGGYCSPAEGFSSRYEHGLMKDLSRGSLSPGGERACEGVPSAPQNPPQRKKVSLLEYRKRKQEAKENSAGGGGDSAQSKSKSAGAGQGSSNSVSDTGAHGVQGSSARTPSSPHKKFSPSHSSMSHLEAVSPSDSRGTSSSHCRPQENISSRWMVPTSVERLREGGSIPKVLRSSVRVAQKGEPSPTWESNITEKDSDPADGEGPETLSSALSKGATVYSPSRYSYQLLQCDSPRTESQSLLQQSSSPFRGHPTQSPGYSYRTTALRPGNPPSHGSSESSLSSTSYSSPAHPVSTDSLAPFTGTPGYFSSQPHSGNSTGSNLPRRSCPSSAASPTLQGPSDSPTSDSVSQSSTGTLSSTSFPQNSRSSLPSDLRTISLPSAGQSAVYQASRVSAVSNSQHYPHRGSGGVHQYRLQPLQGSGVKTQTGLS

SEQ ID NO: 794331 - protein, 176 aa, Homo sapiens
MERKYGFFLSYGKFMVFMKNPTRSLFTQVRHMIADGMIHLCIYAVSAITKDAEVTIAFDYEYSNCNYKVDCACHKGNRNCPIQKRNPNATELPLLPPPPSLPTIGAETRRRKARRKELEMEQQNEASEENNDQQSQEVPEKVTVSSDHEVIAPGQMMMLWHQSSKGRGTRVAAWFK

SEQ ID NO: 794332 - protein, 107 aa, Homo sapiens
PHQNPSHSQGTKEVLNCLLELEEDGPILRVISLDIYGEKLGTLMEGSSSFIPQTYSVPGTLGKIKEIHDRIKRNNPSFLLTQTKINKILSLTSHPLQITHQSSISLP

SEQ ID NO: 794333 - protein, 106 aa, Homo sapiens
PGDKNKKFVYSHPKLKKLEEVVIEHFKSWNAENTTEKKRDETRVMIFSSFRDSVQEIAEMLSQHQPIIRVMTFVGHASGKSTKGFTQKEQLEVIIFGIDKNKNKID

SEQ ID NO: 794334 - protein, 114 aa, Homo sapiens
MRNELLLTGQRFCIRPPHRPAYGKLLEGRYPCLVSWEQSDSAATMHKKLPLKPGGMKETQCHRLFQKQCIHLPARRGELPSKFLAFGLQPLRRRKVAFSKRQLLTAKKSGVSPL

SEQ ID NO: 794335 - protein, 131 aa, Homo sapiens
PSPGGTAPRINWLDEGTMRNELLLTGQRFCIRPPHRPAYGKLLEGRYPCLVSWEQSDSAATMHKKLPLKPGGMKETQCHRLFQKQCIHLPARRGELPSKFLAFGLQPLRRRKVAFSKRQLLTAKKSGVSPL

SEQ ID NO: 794336 - protein, 153 aa, Homo sapiens
LDPTFYADTLTLCQRLFQSVMEGIQGCLPFLCALYKDRIGDSLAEIPSAASLVFSSNSQKSPDLRALVCPKPGKLCSGKEEQRELGCNGDGVNWSKRFCLLEIVAVSEMRSKEPSETLRACLQPGSSREDKTEPPIEARQKRLKMNQLTAHIR

SEQ ID NO: 794337 - protein, 62 aa, Homo sapiens
MWGGREPGLRAPRATSGLWSPHSSWLDEMVQKPSEKSLPCPEPPGTCHGSGDEAHAPWQLLY

SEQ ID NO: 794338 - protein, 121 aa, Homo sapiens
PLGFLLRLLLPGSPLQHSLASQALPPLLVTQEQLAQISVGITQTSSHHPLRSSSAAPMLGGSLIVSLTVATGEARALTHRVLGVPALVATCHGVRLLLSRSPHPPAGDLAHGECQVYACQR

SEQ ID NO: 794339 - protein, 109 aa, Homo sapiens
FEGSYFHSDSNSPSSTLSPMGPILKGHTKLIESLRTALHTVEHSCHCSLSPPSECSYLQFLNLIHSFPDTIALPACFGHDCLKWWLQASLFFTVFMKCIPSVPGTIAGT

SEQ ID NO: 794340 - protein, 152 aa, Homo sapiens
MVSKWQEPWGFQLTISPQAGPSRSPRVPGAPPGWACGPAGLRAALQLGGLLGAEGARPAGRGQHHGQRVAAPLVPAGVQDGVELALEVGLEGVERPQVIGAVGIEEGEFALLIVQVEPDAVGVAGHGQGYPGAGKGFVHPALLQADQPHAVL

SEQ ID NO: 794341 - protein, 189 aa, Homo sapiens
MTDKTEKVAVDPETVFKRPRECDSPSYQKRQRMALLARKQGAGDSLIAGSAMSKEKKLMTGHAIPPSQLDSQIDDFTGFSKDRMMQKPGSNAPVGGNVTSSFSGDDLECRETASSPKSQREINADIKRKLVKELRCVGQKYEKIFEMLEGVQGPTAVRKRFFESIIKEAARCMRRDFVKHLKKKLKRMI

SEQ ID NO: 794342 - protein, 132 aa, Homo sapiens
ERKKKRRRKKGRKERNHHILFFLNHYILNEVTQEWKSKHRMFSLFCSVLFFKMEFRSVVQSGVQWRDLGSPGAEFGTRKYTVYFKRRKVKRYLKIAGAKQAVTTWTFKCGMKCNITLTNSTVKPQMLSFFRC

SEQ ID NO: 794343 - protein, 71 aa, Homo sapiens
MWFDGIMTNRSTLVPDFGSVAVMAQEIDSTVKRNVKKPAFKDEQVNWPVSIKSIELPNFHIFTQYKYSTIF

SEQ ID NO: 794344 - protein, 110 aa, Homo sapiens
NRGPKVPGINSRRGETRTSSKPGPNSIPNSVPNTFSPPAAGCRPPATHTALGNSQSGHPFDAASPKGVGGGSQSVPGYWPHMPDTRVIRSSQQSHCSTKGISGRRQGRVI

SEQ ID NO: 794345 - protein, 203 aa, Homo sapiens
MYQNMDDEMKREHLAAEQRMVHRIQRIMMECHREKVEAVEKARAEERHIAQEAIQAQKSKAVEEIVNTGVTVIKDEKTSVARLMREKEHEMSILYGIAQRQRQEEVQEVLQEAEKTHQATLGNMMDKLANTQGELLSIAKQLGIMTNWKDFLEEELQETRMAFQKYINYTFPKLSPGHADFILPERKKTPSNLVIKENKTTLD

SEQ ID NO: 794346 - protein, 110 aa, Homo sapiens
NPILKRFSYCCSSLKLPLYLLFSDFLLFGASHFLLIPNSFGIWNLNTFLEVCTGTNPLFVLGSMVATILPGWKLRFSCWQLPPLLLLGKKVNPGSWSMGPWIPFGVSSPE

SEQ ID NO: 794347 - protein, 92 aa, Homo sapiens
QRMRDTPHRFPTVNIPSTSGPGLHVSVTCMWLHWPERSWLHANHWPGRIPLLLLLLQLRRVPRAPACAACVNSASSPVAHFGPAGHDQGLSN

SEQ ID NO: 794348 - protein, 124 aa, Homo sapiens
FHNKHTLTYMHTHSHTHVRTHVPSHTLTPSHACTNLLASSHKLTHTHTLTQSHTHLLSHTRVHTRACTLAQTHSCTLPHTHSHKHVLSTLRLTHAHSQSHTCTQLCTHTCTYSHAWINTHSASH

SEQ ID NO: 794349 - protein, 112 aa, Homo sapiens
EIALCSFMYLHFPPSLLVFCCYPWKVSNHPLPGLNIFRSTIHYKVYSNRKRGSQVAVCRRHDFIFTKPHHLSPKTCRIDKQLQQNLRIQNQCAKTQVFLYTNNRQAESQIMN

SEQ ID NO: 794350 - protein, 901 aa, Homo sapiens
LEGALEQERKARMNCERELHKLEGNLKLNRESMENLESSQRHLAEELRKKELELSQMNSKVENEKGLVAQLQKTVKELQTQIKDLKEKLEAERTTRAKMERERADLTQDLADLNERLEEVGGSSLAQLEITKKQETKFQKLHRDMEEATLHFETTSASLKKRHADSLAELEGQVENLQQVKQKLEKDKSDLQLEVDDLLTRVEQMTRAKANAEKLCTLYEERLHEATAKLDKVTQLANDLAAQKTKLWSESGEFLRRLEEKEALINQLSREKSNFTRQIEDLRGQLEKETKSQSALAHALQKAQRDCDLLREQYEEEQEVKAELHRTLSKVNAEMVQWRMKYENNVIQRTEDLEDAKKELAIRLQEAAEAMGVANARNASLERARHQLQLELGDALSDLGKVRSAAARLDQKQLQSGKALADWKQKHEESQALLDASQKEVQALSTELLKLKNTYEESIVGQETLRRENKNLQEEISNLTNQVREGTKNLTEMEKVKKLIEEEKTEVQVTLEETEGALERNESKILHFQLELLEAKAELERKLSEKDEEIENFRRKQQCTIDSLQSSLDSEAKSRIEVTRLKKKMEEDLNEMELQLSCANRQVSEATKSLGQLQIQIKDLQMQLDDSTQLNSDLKEQVAVAERRNSLLQSELEDLRSLQEQTERGRRLSEEELLEATERINLFYTQNTSLLSQKKKLEADVARMQKEAEEVVQECQNAEEKAKKAAIEAANLSEELKKKQDTIAHLERTRENMEQPITDLQKRLAEAEQMALMGSRKQIQKLESRVRELEGELEGEIRRSAEAQRGARRLERCIKELTYQAEEDKKNLSRMQTQMDKLQLKVQNYKQQVEVAETQANQYLSKYKKQQHELNEVKERAEVAESQVNKLKIKAREFGKKVQEE

SEQ ID NO: 794351 - protein, 151 aa, Homo sapiens
MAHSCLRALAFPFSRRPLGEGGIGVKEKAGKEDIWVRELEGELEGEIRRSAEAQRGARRLERCIKELTYQAEEDKKNLSRMQTQMDKLQLKVQNYKQQVEVAETQANQYLSKYKKQQHELNEVKERAEVAESQVNKLKIKAREFGKKVQEE

SEQ ID NO: 794352 - protein, 784 aa, Homo sapiens
LEGALEQERKARMNCERELHKLEGNLKLNRESMENLESSQRHLAEELRKKELELSQMNSKVENEKGLVAQLQKTVKELQTQIKDLKEKLEAERTTRAKMERERADLTQDLADLNERLEEVGGSSLAQLEITKKQETKFQKLHRDMEEATLHFETTSASLKKRHADSLAELEGQVENLQQVKQKLEKDKSDLQLEVDDLLTRVEQMTRAKANAEKLCTLYEERLHEATAKLDKVTQLANDLAAQKTKLWSESGEFLRRLEEKEALINQLSREKSNFTRQIEDLRGQLEKETKSQSALAHALQKAQRDCDLLREQYEEEQEVKAELHRTLSKVNAEMVQWRMKYENNVIQRTEDLEDAKRDFYLTNQVREGTKNLTEMEKVKKLIEEEKTEVQVTLEETEGALERNESKILHFQLELLEAKAELERKLSEKDEEIENFRRKQQCTIDSLQSSLDSEAKSRIEVTRLKKKMEEDLNEMELQLSCANRQVSEATKSLGQLQIQIKDLQMQLDDSTQLNSDLKEQVAVAERRNSLLQSELEDLRSLQEQTERGRRLSEEELLEATERINLFYTQNTSLLSQKKKLEADVARMQKEAEEVVQECQNAEEKAKKAAIEAANLSEELKKKQDTIAHLERTRENMEQPITDLQKRLAEAEQMALMGSRKQIQKLESRVRELEGELEGEIRRSAEAQRGARRLERCIKELTYQAEEDKKNLSRMQTQMDKLQLKVQNYKQQVEVAETQANQYLSKYKKQQHELNEVKERAEVAESQVNKLKIKAREFGKKVQEE

SEQ ID NO: 794353 - protein, 1102 aa, Homo sapiens [sequence omitted]

SEQ ID NO: 794354 - protein, 128 aa, Homo sapiens
TEERFEYVESVVYQILIDKMGFSDAPNAIKIEFAQRIGHQRDCPNAKPRPILVYFETPQQRDSVLKKSYKLKGTGIGISTDILTHDIRERKEKGIPSSQTYESMAIKLSTPEPSDLNRNSYAVLSKSE

SEQ ID NO: 794355 - protein, 128 aa, Homo sapiens
MYTLGITNFPIPGEPGFPLNAMYPKPANKQEDEVMRAYLQHLRQETGLRLCEKVFDPQNDKRCKWWTCFVKRQFMLESFKTWTVKGVRAATISRALGSIFQQDIRIFCLYFIKFYTEERRPCLYLKNS

SEQ ID NO: 794356 - protein, 32 aa, Homo sapiens
MALILKSAGKIYYCLSTRPRGQKWSGDYPLVT

SEQ ID NO: 794357 - protein, 370 aa, Homo sapiens
MGLPASSSGLGLVTRQALVVATVPGDPSWGTGLLAVKMGEPGPPSPPAPKAAPGLIDSFSEMNNYRRAMQKMAEDILSLRRQASILEGENRILRSRLAQQEEEEGQGKASEAQNTVSMKQKLLLSELDMKKLRDRVQHLQNELIRKNDREKELLLLYQAQQPQAALLKQYQGKLQKMKALEETVRHQEKVIEKMERVLEDRLQDRSKPPPLNRQQGKPYTGFPMLSASGLPLGSMGENLPVELYSVLLAENAKLRTELDKNRHQQAPIILQQQALPDLLSGTSDKFNLLAKLEHAQSRILSLESQLEDSARRWGREKQDLATRLQEQEKGFRHPSNSIIIEQPVSDPPGVAPRGSGGGAGSHRTPKVTGP

SEQ ID NO: 794358 - protein, 122 aa, Homo sapiens
MGLPASSSGLGLVTRQALVVATVPGDPSWGTGLLAVKMGEPGPPSPPAPKAAPGLIDSFSVSRPLAHWFWEDGLARLAAGVLGCVAQQPVEVFPEPLKWEAGWRGPGLWPLDARGHRNLLQG

SEQ ID NO: 794359 - protein, 112 aa, Homo sapiens
QETHGPGHSECTETLPAQDLLSGTSDKFNLLAKLEHAQSRILSLESQLEDSARRWGREKQDLATRLQEQEKGFRHPSNSIIIEQPVSDPPGVAPRGSGGGAGSHRTPKVTGP

SEQ ID NO: 794360 - protein, 121 aa, Homo sapiens
QSTGITGMNHRVWPTLRYPLDEKKFLPDIGAELSSVAFPGMLIFSYPMTTVSFVTDHVSHFVHEKAQNQTCSGTLSISFQVQEFSLALFDFSTRVFPPLYPLTIFIPLYCVHFAKLPQILF

SEQ ID NO: 794361 - protein, 352 aa, Homo sapiens
MAPLGYFLLLCSLKQALGSYPIWWSLAVGPQYSSLGSQPILCASIPGLVPKQLRFCRNYVEIMPSVAEGIKIGIQECQHQFRGRRWNCTTVHDSLAIFGPVLDKATRESAFVHAIASAGVAFAVTRSCAEGTAAICGCSSRHQGSPGKGWKWGGCSEDIEFGGMVSREFADARENRPDARSAMNRHNNEAGRQAIASHMHLKCKCHGLSGSCEVKTCWWSQPDFRAIGDFLKDKYDSASEMVVEKHRESRGWVETLRPRYTYFKVPTERDLVYYEASPNFCEPNPETGSFGTRDRTCNVSSHGIDGCDLLCCGRGHNARAERRREKCRCVFHWCCYVSCQECTRVYDVHTCK

SEQ ID NO: 794362 - protein, 117 aa, Homo sapiens
MESSRNDAKDDLGNLNVPDSSLPAENEATGPGFIPPPLAPVRGPLFPVDTRGPFMRRGPPFPPPPPGTMFGASRGYFPPRDFPGPPHAPFAMRNIYPPRGLPPYLHPRPGFYPNPTF

SEQ ID NO: 794363 - protein, 67 aa, Homo sapiens
PKTDLTVPGCHNMPAEEWRLSPGYPKGYCALNWWPHIHSPASAGSGLVQNPHAGSPRGTSAELKAKI

SEQ ID NO: 794364 - protein, 990 aa, Homo sapiens
MLLPCLGIWEKNPPPPPLPSIGIVEVRERGRSEREHTEGPKEVPGHEQGPSLRNPSAGASPAASQVGGGVVQNQLTQPGIELCKATCKEGKHLPNPPPPRALDPLPAPSPVTVTLVLSRGACKASQIQTARRTAATATELETRAQAPSSPSPADRASRLSDLPTESHPSPSLAARLPSAPTLLFRSCLLSDFYFLRTPSQIKSTNKKQGIPPGSSVLFYLVLPLPEDAKLLVDCRGEGFSLLLMCEYTPTSHCLSHLYLSSTPAASPLIPDFPTPFLLLFFFFLKRLRFLLGAQDGRAARDLFEIPQGRRRWAGFSRTTRLLMTWRLAATPREIRCKHVCSRGACVGGLGMGEWERRKETALENAMISFCRVANPLILPRSHSASLLYHFYSGFLVSFFPAPASSPCPHLRFACRYLSGHRRCLKMLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGNRLKVMPFAGVLEHIGGIMEIQLEENPWNCTCDLLPLKAWLDTITVFVGEIVCETPFRLHGKDVTQLTRQDLCPRKSASDSSQRGSHADTHVQRLSPTMNPALNPTRAPKASRPPKMRNRPTPRVTVSKDRQSFGPIMVYQTKSPVPLTCPSSCVCTSQSSDNGLNVNCQERKFTNISDLQPKPTSPKKLYLTGNYLQTVYKNDLLEYSSLDLLHLGNNRIAVIQEGAFTNLTSLRRLYLNGNYLEVLYPSMFDGLQSLQYLYLEYNVIKEIKPLTFDALINLQLLFLNNNLLRSLPDNIFGGTALTRLNLRNNHFSHLPVKGVLDQLPAFIQIDLQENPWDCTCDIMGLKDWTEHANSPVIINEVTCESPAKHA

SEQ ID NO: 794365 - protein, 132 aa, Homo sapiens [sequence omitted]

SEQ ID NO: 794366 - protein, 235 aa, Homo sapiens
QTLGPSGLLICRRLPYGLGPEACALGDAEAKHAHGRPASLQVLHCPAPAPLGHLSPGEALSRDQPLVRMLLMTRLGPSRQSGSTGAGANSTLEKFGCTMLAKLQLNAPTRAEARRRDRRCQPPRAAAASGGHLHASRRAQSQRVHWSTTERSTVPGRRAHARPVGVAAPGAQATRATSLQEHAVSAPGTLWGKVGHRVETTPATLGRRSSKRVATGLASRLQTTEASQQRDRMGG

SEQ ID NO: 794367 - protein, 1491 aa, Homo sapiens
RALSSAAESPQGEQRARGCRGTAAGGGQRGACERADWRRRQLRKVRSVELDQLPEQPLFLAASPPASSTSPSPEPADAAGSGTGFQPVAVPPPHGAASRGGAHLTESVAAPDSGASSPAAAEPGEKRAPAAEPSPAAAPAGREMENKETLKGLHKMDDRPEERMIREKLKATCMPAWKHEWLERRNRRGPVVVKPIPVKGDGSEMNHLAAESPGEVQASAASPASKGRRSPSPGNSPSGRTVKSESPGVRRKRVSPVPFQSGRITPPRRAPSPDGFSPYSPEETNRRVNKVMRARLYLLQQIGPNSFLIGGDSPDNKYRVFIGPQNCSCARGTFCIHLLFVMLRVFQLEPSDPMLWRKTLKNFEVESLFQKYHSRRSSRIKAPSRNTIQKFVSRMSNSHTLSSSSTSTSSSENSIKDEEEQMCPICLLGMLDEESLTVCEDGCRNKLHHHCMSIWAEECRRNREPLICPLCRSKWRSHDFYSHELSSPVDSPSSLRAAQQQTVQQQPLAGSRRNQESNFNLTHYGTQQIPPAYKDLAEPWIQVFGMELVGCLFSRNWNVREMALRRLSHDVSGALLLANGESTGNSGGSSGSSPSGGATSGSSQTSISGDVVEACCSVLSMVCADPVYKVYVAALKTLRAMLVYTPCHSLAERIKLQRLLQPVVDTILVKCADANSRTSQLSISTLLELCKGQAGELAVGREILKAGSIGIGGVDYVLNCILGNQTESNNWQELLGRLCLIDRLLLEFPAEFYPHIVSTDVSQAEPVEIRYKKLLSLLTFALQSIDNSHSMVGKLSRRIYLSSARMVTTVPHVFSKLLEMLSVSSSTHFTRMRRRLMAIADEVEIAEAIQLGVEDTLDGQQDSFLQASVPNNYLETTENSSPECTVHLEKTGKGLCATKLSASSEDISERLASISVGPSSSTTTTTTTTEQPKPMVQTKGRPHSQCLNSSPLSHHSQLMFPALSTPSSSTPSVPAGTATDVSKHRLQGFIPCRIPSASPQTQRKFSLQFHRNCPENKDSDKLSPVFTQSRPLPSSNIHRPKPSRPTPGNTSKQGDPSKNSMTLDLNSSSKCDDSFGCSSNSSNAVIPSDETVFTPVEEKCRLDVNTELNSSIEDLLEASMPSSDTTVTFKSEVAVLSPEKAENDDTYKDDVNHNQKCKEKMEAEEEEALAIAMAMSASQDALPIVPQLQVENGEDIIIIQQDTPETLPGHTKAKQPYREDTEWLKGQQIGLGAFSSCYQAQDVGTGTLMAEKVTYVRNTSSEQEEVVEALREEIRMMSHLNHPNIIRMLGATCEKSNYNLFIEWMAGGSVAHLLSKYGAFKESVVINYTEQLLRGLSYLHENQIIHRDVKGANLLIDSTGQRLRIADFGAAARLASKGTGAGEFQGQLLGTIAFMAPEVLRGQQYGRSCDVWSVGCAIIEMACAKPPWNAEKHSNHLALIFKIASATTAPSIPSHLSPGLRDVALRCLELQPQDRPPSRELLKHPVFRTTW

SEQ ID NO: 794368 - protein, 105 aa, Homo sapiens
FFLQNAVGQPARGLETRLLRAQSSGWAAALCAASRSSGSGVSAEQGEGRRSRILNTSSLKRGKEGGGKNPLYWKTNNPRKLTWSEPIFKVRKYNGDFATLLYGKD

SEQ ID NO: 794369 - protein, 196 aa, Homo sapiens
AGGGSGRRAADLLRPRASPLSSGSGSSSPGGEGWGFLETLRGAPPIGAHHPNLFLARHCAAPQDPLPNMDFLLALVLVSSLYLQAAAEFDGRWPRQIVSSIGLCRYGGRIDCCWGWARQSWGQCQPVCQPRCKHGECIGPNKCKCHPGYAGKTCNQAVGLKDVWFQPGAVALPCNPSTLEGRGGRITRSGYRDHPG

SEQ ID NO: 794370 - protein, 161 aa, Homo sapiens
AGGGSGRRAADLLRPRASPLSSGSGSSSPGGEGWGFLETLRGAPPIGAHHPNLFLARHCAAPQDPLPNMDFLLALVLVSSLYLQAAAEFDGRWPRQIVSSIGLCRYGGRIDCCWGWARQSWGQCQPVCQPRCKHGECIGPNKCKCHPGYAGKTCNQGRKRV

SEQ ID NO: 794371 - protein, 297 aa, Homo sapiens
AGGGSGRRAADLLRPRASPLSSGSGSSSPGGEGWGFLETLRGAPPIGAHHPNLFLARHCAAPQDPLPNMDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRCKQCVNTFGSYICKCHKCFDLMYIGGKYQCHDIDECSLGQYQCSSFA

SEQ ID NO: 794372 - protein, 1036 aa, Homo sapiens
MEVVGDFEYSKRDLVGHGAFAVVFRGRHRQKTDWEVAIKSINKKNLSKSQILLGKEIKILKELQHENIVALYDVQELPNSVFLVMEYCNGGDLADYLQAKGTLSEDTIRVFLHQIAAAMRILHSKGIIHRDLKPQNILLSYANRRKSSVSGIRIKIADFGFARYLHSNMMAATLCGSPMYMAPEVIMSQHYDAKADLWSIGTVIYQCLVGKPPFQANSPQDLRMFYEKNRSLMPSIPRETSPYLANLLLGLLQRNQKDRMDFEAFFSHPFLEQGPVKKSCPVPVPMYSGSVSGSSCGSSPSCRFASPPSLPDMQHIQEENLSSPPLGPPNYLQVSKDSASTSSKNSSCDTDDFVLVPHNISSDHSCDMPMGTAGRRASNEFLVCGGQCQPTVSPHSETAPIPVPTQIRNYQRIEQNLTSTASSGTNVHGSPRSAVVRRSNTSPMGFLRPGSCSPVPADTAQTVGRRLSTGSSRPYSPSPLVGTIPEQFSQCCCGHPQGHDSRSRNSSGSPVPQAQSPQSLLSGARLQSAPTLTDIYQNKQKLRKQHSDPVCPSHTGAGYSYSPQPSRPGSLGTSPTKHLGSSPRSSDWFFKTPLPTIIGSPTKTTAPFKIPKTQASSNLLALVTRHGPAEEQSKDGNEPRECAHCLLVQGSERQRAEQQSKAVFGRSVSTGKLSDQQGKTPICRHQGSTDSLNTERPMDIAPAGACGGVLAPPAGTAASSKAVLFTVGSPPHSAAAPTCTHMFLRTRTTSVGPSNSGGSLCAMSGRVCVGSPPGPGFGSSPPGAEAAPSLRYVPYGASPPSLEGLITFEAPELPEETLMEREHTDTLRHLNVMLMFTECVLDLTAMRGGNPELCTSAVSLYQIQESVVVDQISQLSKDWGRVEQLVLYMKAAQLLAASLHLAKAQIKSGKLSPSTAVKQVVKNLNERYKFCITMRKKLTEKLNRFFSDKQRFIDEINSVTAEKLIYNCAVEMVQSAALDEMFQQTEDIVYRYHKAALLLEGLSRILQDPADIENVHKYKCSIERRLSALCHSTATV

SEQ ID NO: 794373 - protein, 1036 aa, Homo sapiens; identical to SEQ ID NO: 794372

SEQ ID NO: 794374 - protein, 156 aa, Homo sapiens
DSGSRENDEPDEHSGASQKKQIPKEWARAQKVLVLDTSAGLEGPVAADTPWGAAMGGLGKRRCPWRGCGSAGEKWAAPRGGPGGPEGRPCLLGTLRDPWSGGAGLQGVKGEDIFWVLESCGRNGAGRGGAGLGGDVPAACPAPAGSATPAGEGAAV

SEQ ID NO: 794375 - protein, 218 aa, Homo sapiens
MVTDNTHLTLYSLRPMQSPEQAQLPFPSSLTSCLPPSCPSCHPWWPGRPGSPQRFKWLHCWDPHLGGSPGHSEGTQDPASRRNHPPPWLAGKCPWLSWHQCLLIPPGQTLLLQGHLHDISNPLFLRSGSPVWPNSCWLMVIFSRTSSEPSVPVVAILASAAEAAAARLGSSSCRCCCSSIETRGPRPAEDQHWDLLQIQSHWHRDPAWHPLPQPKSEN

SEQ ID NO: 794376 - protein, 208 aa, Homo sapiens
PQSGPGAAAARWSRPGCARVRAMEPRPRRRRRSRPLVAAFLRDPGSGRVYRRGKLIGKGAFSRCYKLTDMSTSAVFALKVVPCGGAGAGWLRPQGKVEREIALHSRLRPRNIVAFHGHFADRDHVYMVLEYCSRQSLAHVLRARQILTEPEVRDYLRGLVSGLRYLHQRCILHRDLKLSNFFLNKNMEVKIGDLGLAAKVGPGGRCHR

SEQ ID NO: 794377 - protein, 82 aa, Homo sapiens
GDAGVCPAEAVARALLPDFEEAPSTYSLPKGWAAQPQTGSLWISEVRDGVYPGFGPVETPHPHPQSLGTSAVPTDAKRKSMG

SEQ ID NO: 794378 - protein, 76 aa, Homo sapiens
TCSTENSMCAAATAGSAVEFGFQWGPVSSPWDFPALQVSQPQAGKWKPGLNLELLHPQRVLGPVDYYSLNKQMNFS

SEQ ID NO: 794379 - protein, 1106 aa, Homo sapiens
AFLPLLIFPSPLFSLSGFGSPLFFPSPPSFPSPFPLPRPSPPCFPALGPGEAPAEKSPPPEARRRRPSGPSRSRAAVGPGGGRRRGRPPRQGPCERLDLFLICDAIPALDSWRLSIYSGVHRGHCILLKNMSNSNTTQETLEIMKESEKKTGGRICKQKQVYIKTPSKEEIEKECEDTSLRQETQRRTSNHGHARKRAKSNSKLKLVRSLAVCEESSTPFADGPLETQDIIQLHISCPSDKEEEKSTKDVSEKEDKDKNKEKIPRKMLSRDSSQEYTDSTGIDLHEFLVNTLKKNPRDRMMLLKLEQEILEFINDNNNQFKKFPQMTSYHRMLLHRVAAYFGMDHNVDQTGKAVIINKTSNTRIPEQRFSEHIKDEKNTEFQQRFILKRDDASMDRDDNQTGQNGYLNDIRLSKEAFSSSSHKRRQIFRGNREGLSRTSSSRQSSTDSELKSLEPRPWSSTDSDGSVRSMRPPVTKASSFSGISILTRGDSIGSSKGGSAGRISRPGMALGAPEVCNQVTSSQSVRGLLPCTAQQQQQQQQQQLPALPPTPQQQPPLNNHMISQADDLSNPFGQMSLSRQGSTEAADPSAALFQTPLISQHPQQTSFIMASTGQPLPTSNYSTSSHAPPTQQVLPPQGYMQPPQQIQVSYYPPGQYPNSNQQYRPLSHPVAYSPQRGQQLPQPSQQPGLQPMMPNQQQAAYQGMIGVQQPQNQGLLSSQRSSMGGQMQGLVVQYTPLPSYQVPVGSDSQNVVQPPFQQPMLVPVSQSVQGGLPAAGVPVYYSMIPPAQQNGTSPSVGFLQPPGSEQYQMPQSPSPCSPPQMPQQYSGVSPSGPGVVVMQLNVPNGPQPPQNPSMVQWSHCKYYSMDQRGQKPGDLYSPDSSPQANTQMSSSPVTSPTQSPAPSPVTSLSSVCTGLSPLPVLTQFPRPGGPAQGDGRYSLLGQPLQYNLSICPPLLHGQSTYTVHQGQSGLKHGNRGKRQALKSASTDLGTADVVLGRVLEVTDLPEGITRTEADKLFTQLAMSGAKIQWLKDAQGLPGGGGGDNSGTAENGRHSDLAALYTIVAVFPSPLAAQNASLRLNNSVSRFKLRMAKKNYDLRILERASSQ

SEQ ID NO: 794380 - protein, 159 aa, Homo sapiens [sequence omitted]

SEQ ID NO: 794381 - protein, 930 aa, Homo sapiens
GWCPLIFTTPSQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGVKLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGSFAVSTSCLLALLRPQPPGGSEALCPWSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSASLLAEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 794382 - protein, 596 aa, Homo sapiens
LKFSKGDHLYVLDTSGGEWWYAHNTTEMGYIPSSYVQPLNYRNSTLSDSGMIDNLPDSPDEVAKELELLGGWTDDKKVPGRMYSNNPFWNGVQTNPFLNGNVPVMPSLDELNPKSTVDLLLFDAGTSSFTESSSATTNSTGNIFDELPVTNGLHAEPPVRRDNPFFRSKRSYSLSELSVLQAKSDAPTSSSFFTGLKSPAPEQFQSREDFRTAWLNHRKLARSCHDLDLLGQSPGWGQTQAVETNIVCKLDSSGGAVQLPDTSISIHVPEGHVAPGETQQISMKALLDPPLELNSDRSCSISPVLEVKLSNLEVKTSIILEMKVSAEIKNDLFSKSTVGLQCLRSDSKEGPYVSVPLNCSCGDTVQAQLHNLEPCMYVAVVAHGPSILYPSTVWDFINKKVTVGLYGPKHIHPSFKTVVTIFGHDCAPKTLLVSEVTRQAPNPITKRWKHLTGTLILVNSLDVLRAAAFSPADQDDFVIGMGPLPSCCSGVQALFCPACPAVTAELKREEGAAAQTDLGPPARLHPSCAALLHRGRGLKGLPTAARCQSHSFLFVKYKFKFKITFLTNGGKGSMRKVVSNFFMDHKGLKENRGTGC

SEQ ID NO: 794383 - protein, 1967 aa, Homo sapiens
MQLCIFCCCCILFYFDLYDFGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEGKDDTGFAAFAMVIITGSDLHNGIIGFSEESQSGLELREGAVMRRLHLIVTRQPNRAFEDVKVFWRVTLNKTVVVLQKDGVNLMEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVIEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 794384 - protein, 1866 aa, Homo sapiens
MQLCIFCCCCILFYFDLYDFGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEGKDDTGFAAFAMVIITGSDLHNGIIGFSEESQSGLELREGAVMRRLHLIVTRQPNRAFEDVKVFWRVTLNKTVVVLQKDGVNLMEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVIEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQLLVPSVLLFTSMRSTFFSFHTGTLTSREKKSTFVLTCLLSPDSKGLGVLCFLNTEWAFQVH

SEQ ID NO: 794385 - protein, 103 aa, Homo sapiens
AYNPWMDIRQREDVQALNISVPYGPIPVDFQRKIRQSYFASVSYLDTQVGRLLSALDDLQLANSTIIAFTSGSWGDICCFPNATFLQIKSRRQHAVHKELMSW

SEQ ID NO: 794386 - protein, 131 aa, Homo sapiens
MHLKSKEKGCAPFGLGKIWGGPLGQDLHSWIFQHPYSKWEILKWKTVPSIAVKRLQVAIIQIKIEEAKQKKEGVNKQLIRRRYEDLEGVEESRDQQCSQSFWLELLEKKPQMPIVKKADPNMKKFHYALVD

SEQ ID NO: 794387 - protein, 35 aa, Homo sapiens
EQSSVLEEICRVRIQPANYLIPACAYSSMHHFPLM

SEQ ID NO: 794388 - protein, 129 aa, Homo sapiens
MCHPGANDTSQLNCNFALSSFALLSRPLDLSGKEETVCGKRKFPPCSQREKPVRILRVSQLLRAGMAYLKTSSDANKTKPLSSGCTVFSICTVSHRAHSNGLPCEPLSSVCVFFFLRDDSSQVKGHFSS

SEQ ID NO: 794389 - protein, 42 aa, Homo sapiens
MSGGGHSKCKGPDMGPGKGAGAGPRWRKRQLQECQMGPSGLC

SEQ ID NO: 794390 - protein, 606 aa, Homo sapiens
MACYIYQLPSWVLDDLCRNMDALSEWDWMEFASYVITDLTQLRKIKSMERVQGVSITRELLWWWGMRQATVQQLVDLLCRLELYRAAQIILNWKPAPEIRCPIPAFPDSVKPEKPLAASVRKAEDEQEEGQPVRMATFPGPGSSPARAHQPAFLQPPEEDAPHSLRSDLPTSSDSKDFSTSIPKQEKLLSLAGDSLFWSEADVVQATDDFNQNRKISQGTFADVYRGHRHGKPFVFKKLRETACSSPGSIERFFQAELQICLRCCHPNVLPVLGFCAARQFHSFIYPYMANGSLQDRLQGQGGSDPLPWPQRVSICSGLLCAVEYLHGLEIIHSNVKSSNVLLDQNLTPKLAHPMAHLCPVNKRSKYTMMKTHLLRTSAAYLPEDFIRVGQLTKRVDIFSCGIVLAEVLTGIPAMDNNRSPVYLKDLLLSEIPSSTASLCSRKTGVENVMAKEICQKYLEKGAGRLPEDCAEALATAACLCLRRRNTSLQEVCGSVAAVEERLRGRETLLPWSGLSEGTGSSSNTPEETDDVDNSSLDASSSMSVAPWAGAATPLLPTENGEGRLRVIVGREADSSSEACVGLEPPQDVTRTLRGKLRSMSAQKGN

SEQ ID NO: 794391 - protein, 333 aa, Homo sapiens
MACYIYQLPSWVLDDLCRNMDALSEWDWMEFASYVITDLTQLRKIKSMERVQGVSITRELLWWWGMRQATVQQLVDLLCRLELYRAAQIILNWKPAPEIRCPIPAFPDSVKPEKPLAASVRKAEDEQEEGQPVRMATFPGPGSSPARAHQPAFLQPPEEDAPHSLRSDLPTSSDSKDFSTSIPKQEKLLSLAGDSLFWSEADVVQATDDFNQNRKISQGTFADVYRGHRHGKPFVFKKLRETACSSPGSIERFFQAELQICLRCCHPNVLPVLGFCAARQFHSFIYPYMANGSQSAGITVGSHCAWPGRLSTCVSVQFLTHLSGPQVLQMPDT

SEQ ID NO: 794392 - protein, 911 aa, Homo sapiens
LGTEDSRDTLEAATSLYDRVDEEVHRLVLTSNNRLQQLEHLRELASLLEGNDQQSCQKGLQLAKENPQRTEEMVQDFRRGLSAVVSQAECREGELARALLVPQVSSWMGPLDPEACPSSPVAECLRSCHQEATSVAAEAFPGAGVAVLKPHALGKPWASQQDLWLQYPQTRLRLEEALSEAAPDPSLPPLAQSPPKHERAQEAMRRHQKPPSFPSTDSGGGAWEPAQPLSGLPGRALLCGQDGETLRPGLCALWDPLSLLRGLPGAGATTAHLEDSSACSSEPTQTLASRPRKHPQKKMIKKTQSFEIPQPDSGPRDSCQPDHTSVFSKGLEVTSTVATEKKLPLWQHARSPPVTQSRSLSSPSGLHPAEEDGRQQPTEAIMAEMIATEREYIRCLGYVIDNYFPEMERMDLPQGLRGKHHVIFGNLEKLHDFHQQHFLRELERCQHCPLAVGRSFLRHEEQFGMYVIYSKNKPQSDALLSSHGNAFFKDKQRELGDKMDLASYLLRPVQRVAKYALLLQDLLKEASCGLAQGQELGELRAAEVVVCFQLRHGNDLLAMDAIRGCDVNLKEQGQLRCRDEFIVCCGRKKYLRHVFLFEDLILFSKTQKVEGSHDVYLYKQSFKTAEIGMTENVGDSGLRFEIWFRRRRKSQDTYILQASSAEVKSAWTDVIGRILWRQALKSRGRRGTPPRQRDLGSHRHEGELSGCPQASYALMAKRGGPCLCPSVGLVLEHLITSPAPLSALHLELPITQLRIQEMASMGIGNQPFMDVKPRDRTPDCAVISDGAPKCAVMSDRVPDSIVKGTESQMRGSTAVSSSDHAAPFKRPHSTISDSSTSSSSSQSSSILGSLGLLVSSSPAHPGLWSPAHSPWSSDIRACVEEDEPEPELETGTQAAVCEGAPAVLLSRTRQA

SEQ ID NO: 794393 - protein, 101 aa, Homo sapiens
FSLKVNFVQYKYRCIRPFLHCYRVIIIKYHRMGALNNKSSFSHSSGSYNSKIKMSAHLVSPEACLGLQLLAFLPCPLMAFFLCTCIPGVSSSSNKDISHIA

SEQ ID NO: 794394 - protein, 66 aa, Homo sapiens
TTATATNTTSVAAAAITIITVTTILATISITTTAVTTTITATATPATAIPTIPTTIAPTATTVFAI

SEQ ID NO: 794395 - protein, 122 aa, Homo sapiens
MEPGVGKKPENKALSFLFYMPASLPLIGAAPITDPQAFFSLSLGKCPVDFTNRCLFLGPRNMREVSQFFSRMAEPSEPSTPTPPSCRGPERDRDLPNTTAMKWTMKIQNHICGLLIPRGDSR

SEQ ID NO: 794396 - protein, 152 aa, Homo sapiens [sequence omitted]

SEQ ID NO: 794397 - protein, 105 aa, Homo sapiens
TRGYSPFSKSFLFLFLRQVLICHTVLECSGMITTNCSLKLLGSSDPLTSASQVAGTTATSHHPWLIVFIFCSDGSLDMLSRLVANSWAQVVILPLQPPKVLGLQA

SEQ ID NO: 794398 - protein, 1576 aa, Homo sapiens
LCNGVNDCGDNSDESPQQNCRPRTGEENCNVNNGGCAQKCQMVRGAVQCTCHTGYRLTEDGHTCQDVNECAEEGYCSQGCTNSEGAFQCWCETGYELRPDRRSCKALGPEPVLLFANRIDIRQVLPHRSEYTLLLNNLENAIALDFHHRRELVFWSDVTLDRILRANLNGSNVEEVVSTGLESPGGLAVDWVHDKLYWTDSGTSRIEVANLDGAHRKVLLWQNLEKPRAIALHPMEGTIYWTDWGNTPRIEASSMDGSGRRIIADTHLFWPNGLTIDYAGRRMYWVDAKHHVIERANLDGSHRKAVISQGLPHPFAITVFEDSLYWTDWHTKSINSANKFTGKNQEIIRNKLHFPMDIHTLHPQRQPAGKNRCGDNNGGCTHLCLPSGQNYTCACPTGFRKISSHACAQSLDKFLLFARRMDIRRISFDTEDLSDDVIPLADVRSAVALDWDSRDDHVYWTDVSTDTISRAKWDGTGQEVVVDTSLESPAGLAIDWVTNKLYWTDAGTDRIEVANTDGSMRTVLIWENLDRPRDIVVEPMGGYMYWTDWGASPKIERAGMDASGRQVIISSNLTWPNGLAIDYGSQRLYWADAGMKTIEFAGLDGSKRKVLIGSQLPHPFGLTLYGERIYWTDWQTKSIQSADRLTGLDRETLQENLENLMDIHVFHRRRPPVSTPCAMENGGCSHLCLRSPNPSGFSCTCPTGINLLSDGKTCSPGMNSFLIFARRIDIRMVSLDIPYFADVVVPINITMKNTIAVGVDPQEGKVYWSDSTLHRISRANLDGSQHEDIITTGLQTTDGLAVDAIGRKVYWTDTGTNRIEVGNLDGSMRKVLVWQNLDSPRAIVLYHEMGFMYWTDWGENAKLERSGMDGSDRAVLINNNLGWPNGLTVDKASSQLLWADAHTERIEAADLNGANRHTLVSPVQHPYGLTLLDSYIYWTDWQTRSIHRADKGTGSNVILVRSNLPGLMDMQAVDRAQPLGFNKCGSRNGGCSHLCLPRPSGFSCACPTGIQLKGDGKTCDPSPETYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVGHVSHPFALTQQDRWIYWTDWQTKSIQRVDKYSGRNKETVLANVEGLMDIIVVSPQRQTGTNACGVNNGGCTHLCFARASDFVCACPDEPDSQPCSLVPGLVPPAPRATGMSEKSPVLPNTPPTTLYSSTTRTRTSLEEVEGRCSERDARLGLCARSNDAVPAAPGEGLHISYAIGGLLSILLILVVIAALMLYRHKKSKFTDPGMGNLTYSNPSYRTSTQEVKIEAIPKPAMYNQLCYKKEGGPDHNYTKEKIKIVEGICLLSGDDAEWDDLKQLRSSRGGLLRDHVCMKTDTVSIQASSGSLDDTEMEQLLQEEQSECSSVHTAATPERRGSLPDTGWKHERKLSSESQV

SEQ ID NO: 794399 - protein, 1023 aa, Homo sapiens
SLEDPLKLLYVCQVIISSNLTWPNGLAIDYGSQRLYWADAGMKTIEFAGLDGSKRKVLIGSQLPHPFGLTLYGERIYWTDWQTKSIQSADRLTGLDRETLQENLENLMDIHVFHRRRPPVSTPCAMENGGCSHLCLRSPNPSGFSCTCPTGINLLSDGKTCSPGMNSFLIFARRIDIRMVSLDIPYFADVVVPINITMKNTIAVGVDPQEGKVYWSDSTLHRISRANLDGSQHEDIITTGLQTTDGLAVDAIGRKVYWTDTGTNRIEVGNLDGSMRKVLVWQNLDSPRAIVLYHEMGFMYWTDWGENAKLERSGMDGSDRAVLINNNLGWPNGLTVDKASSQLLWADAHTERIEAADLNGANRHTLVSPVQHPYGLTLLDSYIYWTDWQTRSIHRADKGTGSNVILVRSNLPGLMDMQAVDRAQPLGFNKCGSRNGGCSHLCLPRPSGFSCACPTGIQLKGDGKTCDPSPETYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVGHVSHPFALTQQDRWIYWTDWQTKSIQRVDKYSGRNKETVLANVEGLMDIIVVSPQRQTGTNACGVNNGGCTHLCFARASDFVCACPDEPDSQPCSLVPGLVPPAPRATGMSEKSPVLPNTPPTTLYSSTTRTRTSLEEVEGRCSERDARLGLCARSNDAVPAAPGEGLHISYAIGGLLSILLILVVIAALMLYRHKKSKFTDPGMGNLTYSNPSYRTSTQEVKIEAIPKPAMYNQLCYKKEGGPDHNYTKEKIKIVEGICLLSGDDAEWDDLKQLRSSRGGLLRDHVCMKTDTVSIQASSGSLDDTEMEQLLQEEQSECSSVHTAATPERRGSLPDTGWKHERKLSSESQV

SEQ ID NO: 794400 - protein, 165 aa, Homo sapiens
SLEDPLKLLYVCQVIISSNLTWPNGLAIDYGSQRLYWADAGMKTIEFAGLDGSKRKVLIGSQLPHPFGLTLYGERIYWTDWQTKSIQSADRLTGLDRETLQENLENLMDIHVFHRRRPPVSTPCAMENGGCSHLCLRSPNPSGFSCTCPTGINLLSDGKTCSPGE

SEQ ID NO: 794401 - protein, 84 aa, Homo sapiens
QKGDLLTCLVFPDVNECAEEGYCSQGCTNSEGAFQCWCETGYELRPDRRSCKALGKGCWHLAGWAEGRAWRKARYSGAQGFAER

SEQ ID NO: 794402 - protein, 160 aa, Homo sapiens
LQGITLYPPALKTAFSAELSSEEAGAQRECYFLGWGCATQKSFLGVTVGEADSVGPISASSSREQRPLPPILLYSLALFDFDGFSGRWVIGWGEDDATCPGASCQELKNHQEEEQQSEEKLQPHKKLNVPQPPVAKLWTSQEQPLDFKGYRISRLATLWS

SEQ ID NO: 794403 - protein, 183 aa, Homo sapiens
MGSAYHWEARRRQMALDRRRWLMAQQQQELQQKEQELKNHQEEEQQSEEKLQPHKKLNVPQPPVAKLWTSQEQPLDFKGYRISETGYSLVIADSGVNCHRHRCGQGHSHHNHSHHLSQHNQVLKPVVLSTPPNAISRIPKGQVTSLLQRGSTKLEGNLCINNRFQGGQKILTDSGLEPGSGRW

SEQ ID NO: 794404 - protein, 150 aa, Homo sapiens
MGSAYHWEARRRQMALDRRRWLMAQQQQELQQKEQELKNHQEEEQQSEEKLQPHKKLNVPQPPVAKLWTSQEQPQPSQQQPSVQPPSQPPPQPSTLPQAQVWPGPQPPQPQPPPQPTQPSAQARCTQHTSKCNLQDSQRPGHQPTSAGIY

SEQ ID NO: 794405 - protein, 150 aa, Homo sapiens; identical to SEQ ID NO: 794404

SEQ ID NO: 794406 - protein, 134 aa, Homo sapiens
MCRNHQWRNCGHHRSNHSHHSSSHQCSHHRSHHHSHQHCHRHRCGQGHSHHNHSHHLSQHNQVLKPVVLSTPPNAISRIPKGQVTSLLQRGSTKLEGNLCINNRFQGLMNPCQSSPIRNTGYSQLKSTNYIQQW

SEQ ID NO: 794407 - protein, 220 aa, Homo sapiens
LQGITLYPPALKTAFSAELSSEEAGAQRECYFLGWGCATQKSFLGVTVGEADSVGPISASSSREQRPLPPILLYSLALFDFDGFSGRWVIGWGEDDATCPGASCQELKNHQEEEQQSEEKLQPHKKLNVPQPPVAKLWTSQEQPQPSQQQPSVQPPSQPPPQPSTLPQAQVWPGPQPPQPQPPPQPTQPSAQARCTQHTSKCNLQDSQRPGHQPTSAGIY

SEQ ID NO: 794408 - protein, 168 aa, Homo sapiens
MGSAYHWEARRRQMALDRRRWLMAQQQQELQQKEQELKNHQEEEQQSEEKLQPHKKLNVPQPPVAKLWTSQEQPQPSQQQPSVQPPSQPPPQPSTLPQAQVWPGPQPPQPQPPPQPTQPSAQARCTQHTSKCNLQDSQRPGLMNPCQSSPIRNTGYSQLKSTNYIQQW

SEQ ID NO: 794409 - protein, 137 aa, Homo sapiens
MALDRRRWLMAQQQQELQQKEQELKNHQEEEQQSEEKLQPHKKLNVPQPPVAKLWTSQEQPQPSQQQPSVQPPSQPPPQPSTLPQAQVWPGPQPPQPQPPPQPTQPSAQARCTQHTSKCNLQDSQRPGHQPTSAGIY

SEQ ID NO: 794410 - protein, 55 aa, Homo sapiens
MLEAGHYPLLAKPDIITLIFHVPPSTKRFQIPRTYRAVSSIFVFLMPARSFPLFC

SEQ ID NO: 794411 - protein, 84 aa, Homo sapiens
LPILFRGYWQSSTSGFPGLHEFCTSLFTCLYCFSTCFSSPLLGLVVFQIILPDLNKMNFAEIDRWLTKIPAKKMQIEVSESAED

SEQ ID NO: 794412 - protein, 452 aa, Homo sapiens
MNSGILQVFQGELICPLCMNYFIDPVTIDCGHSFCRPCFYLNWQDIPFLVQCSECTKSTEQINLKTNIHLKKMASLARKVSLWLFLSSEEQMCGTHRETKKIFCEVDRSLLCLLCSSSQEHRYHRHRPIEWAAEEHREKLLQKMQSLWEKACENHRNLNVETTRTRCWKDYVNLRLEAIRAEYQKMPAFHHEEEKHNLEMLKKKGKEIFHRLHLSKAKMAHRMEILRGMYEELNEMCHKPDVELLQAFGDILHRSESVLLHMPQPLNPELSAGPITGLRDRLNQFRVHITLHHEEANNDIFLYEILRSMCIGCDHQDVPYFTATPRSFLAWGVQTFTSGKYYWEVHVGDSWNWAFGVCNMYRKEKNQNEKIDGKAGLFLLGCVKNDIQCSLFTTSPLMLQYIPKPTSRVGLFLDCEAKTVSFVDVNQSSLIYTIPNCSFSPPLRPIFCCIHF

SEQ ID NO: 794413 - protein, 119 aa, Homo sapiens [sequence omitted]

SEQ ID NO: 794414 - protein, 41 aa, Homo sapiens
MTLRMRRLKAGISMNKLTWTTDLQPPVPIWLLSAIKVITYK

SEQ ID NO: 794415 - protein, 101 aa, Homo sapiens
LISCQLFLLLRSRQVLMANTEDRGRIKKRTLNGLQQPTERLPWDGTNTNFLFRRQDSASDQQLNISKETTCWPEPCPRICHITWPPTADTVKWNDPSVKGP

SEQ ID NO: 794416 - protein, 171 aa, Homo sapiens
DIRQEIEKLTANSQVKKLRWFSECLSPPGGSDNLWNLVAVIKGQDDSLLPQNYCKGIMHLKHLIKFRTSEAQELTTVKMSKFGGGIGVPAKEERLKEAAEIHLRLGQIQRYCELMVELGEWDKALSIAPGVSVKYWKKLMQRRADHLSRKRMMSSILDIHWGCEKAYSFFM

SEQ ID NO: 794417 - protein, 299 aa, Homo sapiens
AKRRESSLGSSHQLLAREKEKASKAWARRVPTGVSGFNLSTSHSEQGTMLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHFLVSLGRAKRAFLPGMNPPPYSQFLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 794418 - protein, 260 aa, Homo sapiens
QVRMGTVRPPRPSLLLVSTRESCLFLLFCLHLGAACPQPCRCPDHAGAVAVFCSLRGLQEVPEDIPANTVLLKLDANKISHLPDGAFQHLHRLRELDLSHNAIEAIGSATFAGLAGGLRLLDLSYNRIQRIPKDALGKLSAKIRLSHNPLHCECALQEALWELKLDPDSVDEIACHTSVQEEFVGKPLVQALDAGASLCSVPHRTTDVAMLVTMFGWFAMVIAYVVYYVRHNQEDARRHLEYLKSLPSAPASKDPIGPGP

SEQ ID NO: 794419 - protein, 749 aa, Homo sapiens
MIDWVSWPLGKNIDKWIIALLKGLAAVKKFSILIEVSLTKIEKVFSKLLYPIVRGAALSVLKYMLLTFQHSHEAFHLLLPHIPPMVASLVKEDSNSGTSCLEQLAELVHCMVFRFPGFPDLYEPVMEAIKDLHVPNEDRIKQLLGQDAWTSQKSELAGFYPRLMAKSDTGKIGLINLGNTCYVNSILQALFMASDFRHCVLRLTENNSQPLMTKLQWLFGFLEHSQRPAISPENFLSASWTPWFSPGTQQDCSEYLKYLLDRLHEEEKTGTRICQKLKQSSSPSPPEEPPAPSSTSVEKMFGGKIVTRICCLCCLNVSSREEAFTDLSLAFPPPERCRRRRLGSVMRPTEDITARELPPPTSAQGPGRVGPRRQRKHCITEDTPPTSLYIEGLDSKEAGGQSSQEERIEREEEGKEERTEKEEVGEEEESTRGEGEREKEEEVEEEEEKVEKETEKEAEQEKEEDSLGAGTHPDAAIPSGERTCGSEGSRSVLDLVNYFLSPEKLTAENRYYCESCASLQDAEKVVELSQGPCYLILTLLRFSFDLRTMRRRKILDDVSIPLLLRLPLAGGRGQAYDLCSVVVHSGVSSESGHYYCYAREGAARPAASLGTADRPEPENQWYLFNDTRVSFSSFESVSNVTSFFPKDTAYVLFYRQRPREGPEAELGSSRVRTEPTLHKDLMEAISKDNILYLQEQEKEARSRAAYISALPTSPHWGRGFDEDKDEDEGSPGGCNPAGGNGGDFHRLVF

SEQ ID NO: 794420 - protein, 104 aa, Homo sapiens
STHLIFLFSSHIFLQVFSRSWLQGLPRTEPTVQETLPHLQCEDGDREGAEQTEMKQVQTAYENLGIQADICPQKQTTSTVSDSHLECIHVFINVHSSTYVKYQC

SEQ ID NO: 794421 - protein, 105 aa, Homo sapiens
MGRPYSQSFQMFFPLLNCSWLRNPAHLEESENQFFNKHIAQTYCEPRVESSIGGRERGSCCVPRLECSGAVSIMPDGSEVQVKDNICNQLTGVDHQNSFPGGKAP

SEQ ID NO: 794422 - protein, 108 aa, Homo sapiens
MGRPYSQSFQMFFPLLNCSWLRNPAHLEESENQFFNKHIAQTYCEPRVESSIGGRERGSCCVPRLECSGAVSIMPDGSEVQVKDNICNQLTGVDHQNSFPGTLRHRRK

SEQ ID NO: 794423 - protein, 115 aa, Homo sapiens
IVSSTHGIEENQISMCKRGKLDFYLTSHTKPNSKWIKDLNIKSEAVKLLEENIGEKLFDIGLVNDFMDMTPKTQATKTKISKVTSNHKASHSKGNNQQSEKKTYEMGESICKRCM

SEQ ID NO: 794424 - protein, 88 aa, Homo sapiens
GDEKVALVCSGCYNKIPAYDYDNRHLFLTVLEARKSEIKMLADSVPGEALFLACKWLPSHCVLTWQTESSLVSLFMRARSCWIRDPPL

SEQ ID NO: 794425 - protein, 302 aa, Homo sapiens
MEFGLLSEAEARSPALSLSDAGTPHPQLPEHGCKGQEHSDSEKASASLPGGSPEDGSLKKKQRRQRTHFTSQQLQELEATFQRNRYPDMSTREEIAVWTNLTEARVRVWFKNRRAKWRKRERSQQAELCKGSFAAPLGGLVPPYEEVYPGYSYGNWPPKALAPPLAAKTFPFAFNSVNVGPLASQPVFSPPSSIAASMVPSAAAAPGTVPGPGALQGLGGGPPGLAPAAVSSGAVSCPYASAAAAAAAAASSPYVYRDPCNSSLASLRLKAKQHASFSYPAVHGPPPAANLSPCQYAVERPV

SEQ ID NO: 794426 - protein, 302 aa, Homo sapiens; identical to SEQ ID NO: 794425

SEQ ID NO: 794427 - protein, 146 aa, Homo sapiens
MHRELAETELQPAWSPEGLAQGMAAVDHSRKCPSPKTHYTSLVGFSLFFGYHNWTKQRYFSCGTGQSDLSNPLSSGLSQSLPGHKNLQHGLGCSVESLASSHCHSLFAGRPCLSESFCRLPPSCTCPQPFPNFSVACAHSQLPPTA

SEQ ID NO: 794428 - protein, 100 aa, Homo sapiens
GESPLARAPGGPGWLTDSLISLQDRRPETAGGHFLRYSQRAYDSNWVPQPWTIPEKMWPHVDQAGTGKGTGLRVWGDSFGGAEAAVVCIPRSWGSDCKRE

SEQ ID NO: 794429 - protein, 144 aa, Homo sapiens
APPGPTPEAVRVTSSSPPTKMLAFQPPVRLVHPINSANAYHMLSVGARPHPQPHRLPGPALGDPPTGRPCPKTRPLHGGKPAMCPSLPRPPPAPAKSDLGRFYNAISTPLNRRRVCTQWCLWLLEIKNPIARVCNYGNLARHPQ

SEQ ID NO: 794430 - protein, 110 aa, Homo sapiens
VIVCFRLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELST

SEQ ID NO: 794431 - protein, 146 aa, Homo sapiens
MFDTVGLCSTWESFTPVAKAGVQWHDLGSLQPPPPRFKHVPLPPTWLGIQVEYHPYLNQSKLLEYCKSKDIVMTAYSALGSDSDKDWVKKGNPVLQEDPILNAIAEKPRRTPAQVALCYQLQRGVVVLVKSFSEKRIKENFQVFDF

SEQ ID NO: 794432 - protein, 130 aa, Homo sapiens
MSFNRLLSVKLNDGKFMPILGFGTSVARKVAMSNVEEAVQVAIDVGYRHIDSAYTHLNEEGIGQAIRKKIANGTVKRKDIFYTTKVWGTFSRPELVQRGLEMSLKKLQLSYMDLYLFHFPVPLQPGRSFC

SEQ ID NO: 794433 - protein, 108 aa, Homo sapiens
AQEIRHETSLQRVEYHPYLNQSKLLEYCKSKDIVMTAYSALGSDSDKDWVKKGNPVLQEDPILNAIAEKPRRTPAQVALCYQLQRGVVVLVKSFSEKRIKENFQVFDF

SEQ ID NO: 794434 - protein, 108 aa, Homo sapiens [sequence omitted]

SEQ ID NO: 794435 - protein, 78 aa, Homo sapiens
SLSLSLSLSLSLSLSLSLSVKKGNPVLQEDPILNAIAEKPRRTPAQVALCYQLQRGVVVLVKSFSEKRIKENFQVFDF

SEQ ID NO: 794436 - protein, 105 aa, Homo sapiens
AQEIRHETSLQRVEYHPYLNQSKLLEYCKSKDIVMTAYSALGSDSDKDWVKKGNPVLQEDPILNAIAEKPRRTPAQVALCYQLQRGVVVLVKSFSEKSRFQVFDF

SEQ ID NO: 794437 - protein, 259 aa, Homo sapiens
MLMAGQRGAWTMGDVVEKSLEGPLAPSTDEPSQKTGDLVEILNGEKVKFDDAGLSLILQNGLETLRMENALTDVILCVDIQEFSCHRVVLAAASNYFRAMFCNDLKEKYEKRIIIKGVDAETMHTLLDYTYTSKALITKQNVQRVLEAANLFQFLRMVDACASFLTEALNPENCVGILRLADTHSLDSLKKQVQSYIIQNFVQILNSEEFLDLPVDTLHHILKSDDLYVTEEAQVFETVMSWVRHKPSERICLLPYVLE

SEQ ID NO: 794438 - protein, 185 aa, Homo sapiens
PGEPGASPRLSPGPSTPPGAPTLPLASPGAPQPPPVTPERSFSASGAQIVSRWPPLPGTLLTEASALSMMDPSPSKTPITLLGPRVLSPTTSRLSTALAATTPPWPPAAPSGGFSGGRVHHVRRSLCPGDSGERTSASGPGCVQGSSKDEPGGDAWAPSCRGPGEDGRPPRLDVTLFPRSVWNVL

SEQ ID NO: 794439 - protein, 124 aa, Homo sapiens
LRESKPTCWESVLWLQPHGRHLCNSSIATWSYATHGSFLWTPLYRNHCSSFDYAHPLPHPMRRGLKYQLLLPPRAVLPTLPCPASLHDPWPGLCLLNDLSLLRDCVSAVCSSLPPPTPLLSGES

SEQ ID NO: 794440 - protein, 632 aa, Homo sapiens
MTPALTALLCLGLSLGPRTRVQAGPFPKPTLWAEPGSVISWGSPVTIWCQGSLEAQEYQLDKEGSPEPWDRNNPLEPKNKARFSIPSMTQHHAGRYRCHYYSSAGWSEPSDPLELVMTGAYSKPTLSALPSPVVASGGNMTLRCGSQKRYHHFVLMKEGEHQLPRTLDSQQLHSGGFQALFPVGPVNPSHRWRFTCYYYYMNTPQVWSHPSDPLEILPSGVSRKPSLLTLQGPVLAPGQSLTLQCGSDVGYDRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 794441 - protein, 80 aa, Homo sapiens
LKCLRGCATRLPKHDWLLCTQIKNGILLLALGMGKYPQLFLVSFPQSVFKPLPMLAPGVGRKKALSIGLGCLDPQWKDES

SEQ ID NO: 794442 - protein, 77 aa, Homo sapiens
DCQGHGVWGSPLSSSVYSAWMTIVWTAEGNPGDLCLYFLEMITVQAKHGAHVVIKYGLGLEMSTEFHRKETLVGSLG

SEQ ID NO: 794443 - protein, 165 aa, Homo sapiens
SGSLAAAGAAGLAFTALCPLLAEAQPLWPCDLQVLRDPQLRRQVPRKPRNGRPEVWSVSSQGSKWIPGAERKLLVYSYFEKETLTFRDVAIEFSLEEWECLNPAQQNLYMNVMLENYKNLVFLAGIAVSKQDPITSLEQEKEPWNMKICEMVDESPSETFGQSKT

SEQ ID NO: 794444 - protein, 383 aa, Homo sapiens
SGSLAAAGAAGLAFTALCPLLAEAQPLWPCDLQVLRDPQLRRQVPRKPRNGRPEVWSVSSQGSKWIPGAERKLLVYSYFEKETLTFRDVAIEFSLEEWECLNPAQQNLYMNVMLENYKNLVFLAGIAVSKQDPITSLEQEKEPWNMKICEMVDESPSAMCSSFTRDLWPEQDIKDSFQQVILRRHGKCEHENLQLRKGSANVVECKVYKKGYNELNQCLTTTQSKIFPCDTYIKVFHKIFNSNRHKTRHTGEKPFKCKKCDESFCMLLHLHQHKRIHIRENSYQCEECDKVFKRFSTLTRHKRVHTGEKPFKCEECGKAFKHSSTLTTHKMIHTGEKPYRCEECGKAFYHSSHLTTHKVIHTGEKPFKCEECGKAFNHPSALT

SEQ ID NO: 794445 - protein, 93 aa, Homo sapiens
SGSLAAAGAAGLAFTALCPLLAEAQPLWPCDLQVLRDPQLRRQVPRKPRNGRPEVWSVSSQGSKWIPGAERKLLVYSYFEKGRAVLPGWSAVA

SEQ ID NO: 794446 - protein, 706 aa, Homo sapiens
MTTLKEAVTFKDVAVVFTEEELRLLDLAQRKLYREVMLENFRNLLSVGHQSLHRDTFHFLKEEKFWMMETATQREGNLGGKIQMEMETVSESGTHEGLFSHQTWEQISSDLTRFQDSMVNSFQFSKQDDMPCQVDAGLSIIHVKTETSEGRTCKKSFSDVSVLDLHQQLQSREKSHTCDECGKSFCYSSALRIHQRVHMGEKLYNCDVCGKEFNQSSHLQIHQRIHTGEKPFKCEQCGKGFSRRSGLYVHRKLHTGVKPHICEKCGKAFIHDSQLQEHQRIHTGEKPFKCDICCKSFRSRANLNRHSMVHMREKPFRCDTCGKSFGLKSALNSHRMVHTGEKRYKCEECGKRFIYRQDLYKHQIDHTGEKPYNCKECGKSFRWASGLSRHVRVHSGETTFKCEECGKGFYTNSQRYSHQRAHSGEKPYRCEECGKGYKRRLDLDFHQRVHRGEKPYNCKECGKSFGWASCLLNHQRIHSGEKPFKCEECGKRFTQNSQLYTHRRVHSGEKPFKCEECGKRFTQNSQLYSHRRVHTGVKPYKCEECGKGFNSKFNLDMHQRVHTGERPYNCKECGKSFSRASSILNHKRLHGDEKPFKCEECGKRFTENSQLHSHQRVHTGEKPYKCEKCGKSFRWASTHLTHQRLHSREKLLQCEDCGKSIVHSSCLKDQQRDQSGEKTSKCEDCGKRYKRRLNLDTLLSLFLNDT

SEQ ID NO: 794447 - protein, 337 aa, Homo sapiens [sequence omitted]

SEQ ID NO: 794448 - protein, 100 aa, Homo sapiens
MVPLSPLNWELVTIYLETMCVTGCTCLAGYKGGISFCLCHLLADCITFWLNAYSIIRQVSFTSMDVRGVSGLSRNLFLNYIFPATPTQPTPPSLKLLPPG

SEQ ID NO: 794449 - protein, 531 aa, Homo sapiens
MEAPAQKAGQGGLPKADAQGASGAREKRPEEPRPLEEDRAGSRPTQKGDLRGAAGGRTTPPGGGSRGCSLGVSPGPGTRHSAGTRPLVREPCGPTSSQNPELVIPEGLQAREGPCRSPARGGDCSRNSCLAWHRGAPAGETPPVCDPCPERIQNHPRTQLCEVHTDCWPCQPGTGAPTCPRTPKPTSRGRNPLVEQPRACACGEAFAWRALRIPQERLQATEEPRPCARCGKRFRPNQQQQAGKSPPVCPECGQTSRPRPIVPDPPAQRLYACDECGKAFTRTSSLLQHQRIHTGERPYECAECGKAFVRCSGLYRHQKTHSAERHRRGPVLARRAFRLGCPPCGDYSERSPRRGSGAGEKPYECADCAKAFGLFSHLVEHRRVHTGEKPYACPECGKAFNQRSNLSRHQRTHSSAKPYACPLCEKAFKGRSGLVQHQRAHTGERPYGCSECGKTFRGCSELRQHERLHSGEKPYICRDCGKAFVRNCSLVRHLRTHTGERPYACGDCGRAFSQRSNLNEHRKRHGGRAAP

SEQ ID NO: 794450 - protein, 531 aa, Homo sapiens; identical to SEQ ID NO: 794449

SEQ ID NO: 794451 - protein, 651 aa, Homo sapiens
PALAVARVPQCRGGPEVAGGRLRAACGAGTRDPCGPPPENEAASLESTTVTWLKRGGEVQHWPLQRGSPGQALSCQVSLTSHLSEDMDNGSEWSQEDPECRLATEKLEGRNPTTRTLRPRMEAPAQKAGQGGLPKADAQGASGAREKRPEEPRPLEEDRAGSRPTQKGDLRGAAGGRTTPPGGGSRGCSLGVSPGPGTRHSAGTRPLVREPCGPTSSQNPELVIPEGLQAREGPCRSPARGGDCSRNSCLAWHRGAPAGETPPVCDPCPERIQNHPRTQLCEVHTDCWPCQPGTGAPTCPRTPKPTSRGRNPLVEQPRACACGEAFAWRALRIPQERLQATEEPRPCARCGKRFRPNQQQQAGKSPPVCPECGQTSRPRPIVPDPPAQRLYACDECGKAFTRTSSLLQHQRIHTGERPYECAECGKAFVRCSGLYRHQKTHSAERHRRGPVLARRAFRLGCPPCGDYSERSPRRGSGAGEKPYECADCAKAFGLFSHLVEHRRVHTGEKPYACPECGKAFNQRSNLSRHQRTHSSAKPYACPLCEKAFKGRSGLVQHQRAHTGERPYGCSECGKTFRGCSELRQHERLHSGEKPYICRDCGKAFVRNCSLVRHLRTHTGERPYACGDCGRAFSQRSNLNEHRKRHGGRAAP

SEQ ID NO: 794452 - protein, 97 aa, Homo sapiens
PQPPLCIREPPLLWPTFPSGKAPLLPKEQCHSASSQGGSKHAQLCPSLLFFPKPTFGAHTFSASPLVKPLEAALPYFVERVRPNVVQCHLRLHEPQN

SEQ ID NO: 794453 - protein, 133 aa, Homo sapiens
LSTVLKNGLKTTVCQVASHLNAPTALTYSFTYTPCSQKTRPCISAPAAKTQPCRVTAFLCRNLRGPPGSCGATKAFGEHFLQEPRQKIQNIIAPAHSSMWQRYILCSYLECGFSLACDSALLTDLKNDKHIQI

SEQ ID NO: 794454 - protein, 95 aa, Homo sapiens
QSCQQAPNRGCRPEGSRRGVGGGRRVRMRRLQRPFWAGPAALGWRVGLFDPFQVRQRGVTRGKRSRSVRMGRPNTVPGSLREAAGRLELGSRVSR

SEQ ID NO: 794455 - protein, 40 aa, Homo sapiens
CWAPWCSPACGVWPKWPMWTLFQGFYDKKHQNEDISVAMF

SEQ ID NO: 794456 - protein, 113 aa, Homo sapiens
YGLEHWLLTRMPVSLGPSILGTGPEHRPWSVLPGFGSLPCAGGESERQDDSRAGQTLPRGAQQGLGGQSWPCWEQWVEALEGQVQAGLRNSNPTPVEKPSAALQKIQKGSWVW

SEQ ID NO: 794457 - protein, 152 aa, Homo sapiens
MLPFRASLGQFAALLFLLQGGEAGAGVTGGVLVKFLLPPGRWLGELQEDRLCGLLPSPDPDSLDSAAQTVQQVIPCLCPKPPGQGISGIGLLKPYTAFISCRPNNPKGQPHCTDKETEVEQFTQVRPPLSARGRSEDTQGLRCRWVVQELHL

SEQ ID NO: 794458 - protein, 244 aa, Homo sapiens
MLPFRASLGQFAALLFLLQGGEAGAGVTGGVLVKFLLPPGRWLGELQEDRLCGLLPSPDPDSLDSAAQTVQQAATYTGRIFYNNETFPSVLDPCLSCICLLGSVACSPVDCPITCTYPFHPDGECCPVCRDCNYEGRKVANGQVFTLDDEPCTRCTCQLGEVSCEKVPCQRACADPALLPGDCCSSCPDSLSPLEEKQGLSPHGNVAFSKAGRSLHGDTEAPVNCSSCPGPPTASPSRPVLHLL

SEQ ID NO: 794459 - protein, 74 aa, Homo sapiens
TGGTRPLLSQGHADGLKLDSSEERPVGGLPDADQGRAEGKPHGRPSYGGHSFLGTPVNNLPLWPPPRPAVPTPH

SEQ ID NO: 794460 - protein, 81 aa, Homo sapiens
KPILKAGRAYHKYKAKRNCWPQLRGVAINPVEHPFGGGNHQHIGKPSTIRRDAPAGRKVGLIAARRTGRLRGTKTVQEKEN

SEQ ID NO: 794461 - protein, 87 aa, Homo sapiens
TTERKEVPRALSRERAAEPPLTGACTWRATVRTEPTAPASGRFRHRRIVWSPQRGDRFLQLAAEDVASAALTAAASVNCGSWDSGQG

SEQ ID NO: 794462 - protein, 265 aa, Homo sapiens
MGEKVSEAPEPVPRGCSGHGSRTPASALVAASSPGASSAESSSGSETLSEEGEPGGFSREHQPPPPPPLGGTLGARAPAAWAPASVLLERGVLALPPPLPGGAVPPAPRGSSASQEEQDEELDHILSPPPMPFRKCSNPDVASGPGKSLKYKRQLSEDGRQLRRGSLGGALTGRYLLPNPVAGQAWPASAETSNLVRMRSQALGQSAPSLTASLKELSLPRRGSFLTPRSLSPTPSSPGSPCSPLLAFHFWSPVCPNAGRTSPLG

SEQ ID NO: 794463 - protein, 252 aa, Homo sapiens
MGEKVSEAPEPVPRGCSGHGSRTPASALVAASSPGASSAESSSGSETLSEEGEPGGFSREHQPPPPPPLGGTLGARAPAAWAPASVLLERGVLALPPPLPGGAVPPAPRGSSASQEEQDEELDHILSPPPMPFRKCSNPDVASGPGKSLKYKRQLSEDGRQLRRGSLGGALTGRYLLPNPVAGQAWPASAETSNLVRMRSQALGQSAPSLTASLKELSLPRRGSFLTPRSLSPTPSSPGSPCSPLLAFHFWR

SEQ ID NO: 794464 - protein, 257 aa, Homo sapiens
MGEKVSEAPEPVPRGCSGHGSRTPASALVAASSPGASSAESSSGSETLSEEGEPGGFSREHQPPPPPPLGGTLGARAPAAWAPASVLLERGVLALPPPLPGGAVPPAPRGSSASQEEQDEELDHILSPPPMPFRKCSNPDVASGPGKSLKYKRQLSEDGRQLRRGSLGGALTGRYLLPNPVAGQAWPASAETSNLVRMRSQALGQSAPSLTASLLSLFLVFKQIDICGGALCSRTFLMLMILSSWPLCLPLAPVVEL

SEQ ID NO: 794465 - protein, 250 aa, Homo sapiens
MGEKVSEAPEPVPRGCSGHGSRTPASALVAASSPGASSAESSSGSETLSEEGEPGGFSREHQPPPPPPLGGTLGARAPAAWAPASVLLERGVLALPPPLPGGAVPPAPRGSSASQEEQDEELDHILSPPPMPFRKCSNPDVASGPGKSLKYKRQLSEDGRQLRRGSLGGALTGRYLLPNPVAGQAWPASAETSNLVRMRSQALGQSAPSLTASLKELSLPRRGSLCRSSDCDWVIDKRSERNCFLGKMLL

SEQ ID NO: 794466 - protein, 221 aa, Homo sapiens
MAPEPVPRGCSGHGSRTPASALVAASSPGASSAESSSGSETLSEEGEPGGFSREHQPPPPPPLGGTLGARAPAAWAPASVLLERGVLALPPPLPGGAVPPAPRGSSASQEEQDEELDHILSPPPMPFRKCSNPDVASGPGKSLKYKRQLSEDGRQLRRGSLGGALTGRYLLPNPVAGQAWPASAETSNLVRMRSQALGQSAPSLTASLPVCPNAGRTSPLG

SEQ ID NO: 794467 - protein, 277 aa, Homo sapiens
MGEKVSEAPEPVPRGCSGHGSRTPASALVAASSPGASSAESSSGSETLSEEGEPGGFSREHQPPPPPPLGGTLGARAPAAWAPASVLLERGVLALPPPLPGGAVPPAPRGSSASQEEQDEELDHILSPPPMPFRKCSNPDVASGPGKSLKYKRQLSEDGRQLRRGSLGGALTGRYLLPNPVAGQAWPASAETSNLVRMRSQALGQSAPSLTASLKELSLPRRGSLIDSQKWNCLVKRLTPRSLSPTPSSPGSPCSPLLAFHFWSPVCPNAGRTSPLG

SEQ ID NO: 794468 - protein, 296 aa, Homo sapiens
SLPWAPRDGLPLPGRETAGNWLPETRRLVNPALPTWWSSAMPMPSRDGGLHPRHHHYGSHSPWSQLLSSPMETPSIKGLYYRRVRKVGALDASPVDLKKEILINVGGRRYLLPWSTLDRFPLSRLSKLRLCRSYEEIVQLCDDYDEDSQEFFFDRSPSAFGVIVSFLAAGKLVLLQEMCALSFQEELAYWGIEEAHLERCCLRKLLRKLEELEELAKLHREDVLRQQRETRRPASHSSRWGLCMNRLREMVENPQSGLPGKVFACLSILFVATTAVSLCVSTMPDLRAEEDQVSGL

SEQ ID NO: 794469 - protein, 219 aa, Homo sapiens
MNSSKSSETQCTERGCFSSQMFLWTVAGIPILFLSACFITRCVVTFRIFQTCDEKKFQLPENFTELSCYNYGSGSVKNCCPLNWEYFQSSCYFFSTDTISWALSLKNCSAMGAHLVVINSQEEQEFLSYKKPKMREFFIGLSDQVVEGQWQWVDGTPLTKSLSFWDVGEPNNIATLEDCATMRDSSNPRQNWNDVTCFLNYFRICEMVGINPLNKGKSL

SEQ ID NO: 794470 - protein, 219 aa, Homo sapiens; identical to SEQ ID NO: 794469

SEQ ID NO: 794471 - protein, 219 aa, Homo sapiens; identical to SEQ ID NO: 794469

SEQ ID NO: 794472 - protein, 154 aa, Homo sapiens
MNSSKSSETQCTERGCFSSQMFLWTVAGIPILFLSACFITRCVVTFRIFQTCDEKKFQLPENFTELSCYNYGSGSVKNCCPLNWEYFQSSCYFFSTDTISWALSLKNCSAMGAHLVVINSQEEQLLGCRGAQQHSYPGGLCHHERLFKPKAKLE

SEQ ID NO: 794473 - protein, 1112 aa, Homo sapiens
KRNWDSNRRRLLVCGSGLAAAGQRPLAMDTPENVLQMLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAGCVNKSTHEFKPQSGAEIKEGCETHKVANTSSFHTTPNTSLGMVQATPSKVQPSPTVHTKEALGFIMNMFQAPTLPDISDDKDEWQSLDQNEDAFEAQFQKNVRSSGAWGVNKIISSLSSAFHVFEDGNKENYGLPQPKNKPTGARTFGERSVSRLPSKPKEEVPHAEEFLDDSTVWGIRCNKTLAPSPKSPGDFTSAAQLASTPFHKLPVESVHILEDKENVVAKQCTQATLDSCEENMVVPSRDGKFSPIQEKSPKQALSSHMYSASLLRLSQPAAGGVLTCEAELGVEACRLTDTDAAIAEDPPDAIAGLQAEWMQMSSLGTVDAPNFIVGNPWDDKLIFKLLSGLSKPVSSYPNTFEWQCKLPAIKPKTEFQLGSKLVYVHHLLGEGAFAQVYEATQGDLNDAKNKQKFVLKVQKPANPWEFYIGTQLMERLKPSMQHMFMKFYSAHLFQNGSVLVGELYSYGTLLNAINLYKNTPEKVMPQGLVISFAMRMLYMIEQVHDCEIIHGDIKPDNFILGNGFLEQDDEDDLSAGLALIDLGQSIDMKLFPKGTIFTAKCETSGFQCVEMLSNKPWNYQIDYFGVAATVYCMLFGTYMKVKNEGGECKPEGLFRRLPHLDMWNEFFHVMLNIPDCHHLPSLDLLRQKLKKVFQQHYTNKIRALRNRLIVLLLECKRSRK

SEQ ID NO: 794474 - protein, 433 aa, Homo sapiens
KRNWDSNRRRLLVCGSGLAAAGQRPLAMDTPENVLQMLEAHMQSYKGNDPLGEWERYIQWVEENFPENKEYLITLLEHLMKEFLDKKKYHNDPRFISYCLKFAEYNSDLHQFFEFLYNHGIGTLSSPLYIAWAGHLEAQGELQHASAVLQRGIQNQAEPREFLQQQYRLFQTRLTETHLPAQARTSEPLHNVQVLNQMITSKSNPGNNMACISKNQGSELSGVISSACDKESNMERRVITISKSEYSVHSSLASKVDVEQVVMYCKEKLIRGESEFSFEELRAQKYNQRRKHEQWVNEDRHYMKRKEANAFEEQLLKQKMDELHKKLHQVVETSHEDLPASQERSEVNPARMGPSVGSQQELRAPCLPVTYQQTPVNMEKNPREAPPVVPPLANAISAALVSPATSQSIAPPVPLKAQTVTDSMFAVASKDAG

SEQ ID NO: 794475 - protein, 115 aa, Homo sapiens
MVQQLDRDAPHFPDGGAARKRRSLLPDGRAAEQRHSSFLSAAARQRHTSCPRRCGSQAEALLTSQAVQWPGKGASHSQTGLGARERRCSLPRQWGSWAEVLLTSQKVGQLGRGAP

SEQ ID NO: 794476 - protein, 256 aa, Homo sapiens
GRERASERAAGAVLPQHQPGHAAASSPAPRAQAGPSRAEPGRARAMLLTVYCVRRDLSEVTFSLQVDADFELHNFRALCELESGIPAAESQIVYAERPLTDNHRSLASYGLKDGDVVILRQKENADPRPPVQFPNLPRIDFSSIAVPGTSSPRQRQPPGTQQSHSSPGEITSSPQGLDNPALLRDMLLANPHELSLLKERNPPLAEALLSGDLEKFSRVLVEQQQDRARREQERIRLFSADPFDLEAQAKIEEDIR

SEQ ID NO: 794477 - protein, 304 aa, Homo sapiens
MPYVDRQNRICGFLDIEEHENSGKFLRRYFILDTQANCLLWYMDNPQNLAMGAGAVGALQLTYISKVSIATPKQKPKTPFCFVINALSQRYFLQANDQKDMKDWVEALNQASKITVPKGGGLPMTTEVLKSLAAPPALEKKPQVAYKTEIIGGVVVHTPISQNGGDGQEGSEPGSHTILRRSQSYIPTSGCRASTGPPLIKSGYCVKQGNVRKSWKRRFFALDDFTICYFKCEQDREPLRTIFFKDVLKTHECLVKSGDLLMRDNLFEIITSSRTFYVQADSPEDMHSWIKEIGAAVQALKCHP

SEQ ID NO: 794478 - protein, 304 aa, Homo sapiens; identical to SEQ ID NO: 794477

SEQ ID NO: 794479 - protein, 228 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLP

SEQ ID NO: 794480 - protein, 113 aa, Homo sapiens
QVSITTSPPHPTPNLEVHQNSFTIIRERPRQFHRCLGVKPGGSCHLFCRHFTDQKSVPGLQPAVKETGKSSQAVFAESWIQPELGVCRTGTKKQVKGKELVNVSEQVNIKIDL

SEQ ID NO: 794481 - protein, 223 aa, Homo sapiens [sequence omitted]

SEQ ID NO: 794482 - protein, 431 aa, Homo sapiens
REGAREGAREGKGERELPQMLGIIPLPFGKPQPQSRRRPLRPPSASSASRPARGSLRRAMATSPQKSPSVPKSPTPKSPPSRKKDDSFLGKLGGTLARRKKAKEVSELQEEGMNAINLPLSPIPFELDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRHERDAFDTLFDHAPDKLNVVKKTLITFVNKHLNKLNLEVTELETQFADGVYLVLLMGLLEGYFVPLHSFFLTPDSFEQKVLNVSFAFELMQDGGLEKPKPRPEDIVNCDLKSTLRVLYNLFTKYRNVE

SEQ ID NO: 794483 - protein, 431 aa, Homo sapiens; identical to SEQ ID NO: 794482

SEQ ID NO: 794484 - protein, 119 aa, Homo sapiens
VHEDLLGPVVQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQFLEKLLHNLGYR

SEQ ID NO: 794485 - protein, 369 aa, Homo sapiens
AAAYYYYIRGRADPKSPPSRKKDDSFLGKLGGTLARRKKAKEVSELQEEGMNAINLPLSPIPFELDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRHERDAFDTLFDHAPDKLNVVKKTLITFVNKHLNKLNLEVTELETQFADGVYLVLLMGLLEGYFVPLHSFFLTPDSFEQKVLNVSFAFELMQDGGLEKPKPRPEDIVNCDLKSTLRVLYNLFTKYRNVE

SEQ ID NO: 794486 - protein, 307 aa, Homo sapiens
PGGESAEAMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRHERDAFDTLFDHAPDKLNVVKKTLITFVNKHLNKLNLEVTELETQFADGVYLVLLMGLLEGYFVPLHSFFLTPDSFEQKVLNVSFAFELMQDGGLEKPKPRPEDIVNCDLKSTLRVLYNLFTKYRNVE

SEQ ID NO: 794487 - protein, 330 aa, Homo sapiens
MPQLPPGFSTSSLSPVYSSTLHSLLLDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRHERDAFDTLFDHAPDKLNVVKKTLITFVNKHLNKLNLEVTELETQFADGVYLVLLMGLLEGYFVPLHSFFLTPDSFEQKVLNVSFAFELMQDGGLEKPKPRPEDIVNCDLKSTLRVLYNLFTKYRNVE

SEQ ID NO: 794488 - protein, 431 aa, Homo sapiens; identical to SEQ ID NO: 794482

SEQ ID NO: 794489 - protein, 88 aa, Homo sapiens
VLSHKCKRQEEAGKAVRRRVQYANSKNSWAVVGPGSPSLHVRYLVKRLYNTRSVDFRSQLTVLSHKSSCNPEIVETEIRKEIINNSVG

SEQ ID NO: 794490 - protein, 113 aa, Homo sapiens
REGAREGAREGKGERELPQMLGIIPLPFGKPQPQSRRRPLRPPSASSASRPARGSLRRAMATSPQKSPSVPKSPTPKSPPSRKKDDSFLGKLGGTLARRKKAKEAQRAGHGPM

SEQ ID NO: 794491 - protein, 241 aa, Homo sapiens
REGAREGAREGKGERELPQMLGIIPLPFGKPQPQSRRRPLRPPSASSASRPARGSLRRAMATSPQKSPSVPKSPTPKSPPSRKKDDSFLGKLGGTLARRKKAKEVSELQEEGMNAINLPLSPIPFELDPEDTMLEENEVRTMVDPNSRSDPKLQELMKVLIDWINDVLVGERIIVKDLAEDLYDGQVLQKLFGRRVECCNGCVFNCRWLDHLLVARRSYSQFTVAYLEMDYKCVEHGITAQ

SEQ ID NO: 794492 - protein, 431 aa, Homo sapiens; identical to SEQ ID NO: 794482

SEQ ID NO: 794493 - protein, 328 aa, Homo sapiens
MVSELQEEGMNAINLPLSPIPFELDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRHERDAFDTLFDHAPDKLNVVKKTLITFVNKHLNKLNLEVTELETQFADGVYLVLLMGLLEGYFVPLHSFFLTPDSFEQKVLNVSFAFELMQDGGLEKPKPRPEDIVNCDLKSTLRVLYNLFTKYRNVE

SEQ ID NO: 794494 - protein, 202 aa, Homo sapiens
ELGTPTPPQLLLPLHQSPSFLGGWALPSSLFPSCTFDYRSASIQVVVVQKREGILQSRQIQEEITGNTEALSGRHERDAFDTLFDHAPDKLNVVKKTLITFVNKHLNKLNLEVTELETQFADGVYLVLLMGLLEGYFVPLHSFFLTPDSFEQKVLNVSFAFELMQDGGLEKPKPRPEDIVNCDLKSTLRVLYNLFTKYRNVE

SEQ ID NO: 794495 - protein, 431 aa, Homo sapiens; identical to SEQ ID NO: 794482

SEQ ID NO: 794496 - protein, 104 aa, Homo sapiens
GNLRVATAKTKLLPVTWKLLAQLPQVSEWQPIAPRQVAQATVLRSGHPPPTSAPHTQPGGQCAQPSSPQPFWRLQSPQGSPVLPLHLRWSLPGWWPAWLLRVLA

SEQ ID NO: 794497 - protein, 107 aa, Homo sapiens
SEKHFLSKALYSWPGACLPLFSQDRDLQELLPLPHPPPPTSFPASWVLWPPALQAHWRWSWLPITLLGTCSQLLCPPTAPGSLLKQSSPLSSLSLASSFTSFLPIAI

SEQ ID NO: 794498 - protein, 655 aa, Homo sapiens
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLGYGDMVPKTIAGKIFGSICSLSGVLVIALPVPVIVSNFSRIYHQNQRADKRRAQKKARLARIRVAKTGSSNAYLHSKRNGLLNEALELTGTPEEEHMGKTTSLIESQHHHLLHCLEKTTGLSYLVDDPLLSVRTSTIKNHEFIDEQMFEQNCMESSMQNYPSTRSPSLSSHPGLTTTCCSRRSKKTTHLPNSNLPATRLRSMQELSTIHIQGSEQPSLTTSRSSLNLKADDGLRPNCKTSQITTAIISIPTPPALTPEGESRPPPASPGPNTNIPSIASNVVKVSVL

SEQ ID NO: 794499 - protein, 636 aa, Homo sapiens
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLGYGDMVPKTIAGKIFGSICSLSGVLVIALPVPVIVSNFSRIYHQNQRADKRRAQKKARLARIRVAKTGSSNAYLHSKRNGLLNEALELTGTPEEEHMGKTTSLIESQHHHLLHCLEKTTNHEFIDEQMFEQNCMESSMQNYPSTRSPSLSSHPGLTTTCCSRRSKKTTHLPNSNLPATRLRSMQELSTIHIQGSEQPSLTTSRSSLNLKADDGLRPNCKTSQITTAIISIPTPPALTPEGESRPPPASPGPNTNIPSIASNVVKVSVL

SEQ ID NO: 794500 - protein, 153 aa, Homo sapiens
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYVTDLGNMPVCYQGLITGMQLPGDEKMKNMTKLSSHTGCH

SEQ ID NO: 794501 - protein, 369 aa, Homo sapiens
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLG

SEQ ID NO: 794502 - protein, 95 aa, Homo sapiens
HDDNDGPDAEDSDQTSRVCLRSTTSTGPWLAASMLLHPQIADREGSAESSEARMALRFSGFPGPRGIRQPDATRPGLESQPQPACRTCFGSSKPP

SEQ ID NO: 794503 - protein, 67 aa, Homo sapiens
YENLLGHQCDDVQRQGQTPDLWLCLVLPHPFIGLMGQLKNLHNRKIGQSLNIVTNLHFFMKKAQYLP

SEQ ID NO: 794504 - protein, 85 aa, Homo sapiens
GSSLRFQIGTPRLGCLCAVCGECRGADVPGGGALLLLKTGPSALLGLLNWAEGMCSAHVGPEVSGEVVTGTGGAQKPCPLGEWAA

SEQ ID NO: 794505 - protein, 106 aa, Homo sapiens
EIILALEHVVFDCKILMLDITTIYYLTLGKVLASTSSFTNRNTCHEGLRQELNNYAHVHTHTHTLICIVSNSVHLAVRSQYISPRFSAPKYSALLIHAKINCSDIC

SEQ ID NO: 794506 - protein, 141 aa, Homo sapiens
GHPGVAGPGLGWGSPDRGSPTLGHWRGTVSARARQCRPADPLPGGTGEEEGAPAPASLQTTSPKSCGRLSPPCTPLSALSSLPLFGMLSSWGSAGAGWHLGCSPGPCACQNVGCSVATPARGPTCLEQDLHPCQVLDKGGR

SEQ ID NO: 794507 - protein, 398 aa, Homo sapiens
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 794508 - protein, 462 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 794509 - protein, 398 aa, Homo sapiens; identical to SEQ ID NO: 794507

SEQ ID NO: 794510 - protein, 287 aa, Homo sapiens
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRLTSEKETIPGRKSNEGSLLISQGLKARRSQLRNQMLQRMVRALKIPQGQRVSCPRRRNQISSP

SEQ ID NO: 794511 - protein, 140 aa, Homo sapiens
LPREPESPVSRLPWQRARLEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRVRGAFYQNRGLLWEL

SEQ ID NO: 794512 - protein, 50 aa, Homo sapiens
MGCKEPKGLTTITDLRKGPGEGKGRSCEKGQGSSEESTEELLLPEGVLRS

SEQ ID NO: 794513 - protein, 462 aa, Homo sapiens; identical to SEQ ID NO: 794508

SEQ ID NO: 794514 - protein, 462 aa, Homo sapiens; identical to SEQ ID NO: 794508

SEQ ID NO: 794515 - protein, 462 aa, Homo sapiens; identical to SEQ ID NO: 794508

SEQ ID NO: 794516 - protein, 462 aa, Homo sapiens; identical to SEQ ID NO: 794508

SEQ ID NO: 794517 - protein, 398 aa, Homo sapiens; identical to SEQ ID NO: 794507

SEQ ID NO: 794518 - protein, 462 aa, Homo sapiens; identical to SEQ ID NO: 794508

SEQ ID NO: 794519 - protein, 452 aa, Homo sapiens
LPREPESPVSRLPWQRARLEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 794520 - protein, 462 aa, Homo sapiens; identical to SEQ ID NO: 794508

SEQ ID NO: 794521 - protein, 370 aa, Homo sapiens
MARGGVQVAEQLGTQGLNLGPDTLLSRPWSTTLQYLPYCGPRRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 794522 - protein, 369 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGKGVGWGAVEVG

SEQ ID NO: 794523 - protein, 415 aa, Homo sapiens
LPREPESPVSRLPWQRARLVSRQPCGSRRAGFHGCTIRNHQLLHPMARGGVQVAEQLGTQGLNLGPDTLLSRPWSTTLQYLPYCGPRRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 794524 - protein, 418 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGEGHPAA

SEQ ID NO: 794525 - protein, 118 aa, Homo sapiens
MARGGVQVAEQLGTQGLNLGPDTLLSRPWSTTLQYLPYCGPRRWAKSWQAVPAGCCCSLGCSSAPSSFCSGCLSSSMAPSTIPICRQSATSALCISTTGPTVIPPPPHSAPSLLPMSR

SEQ ID NO: 794526 - protein, 305 aa, Homo sapiens
DAWVDPLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 794527 - protein, 308 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLSLGSSEPAGGALRQRPTCSSS

SEQ ID NO: 794528 - protein, 417 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 794529 - protein, 150 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRVRGAFYQNRGLLWEL

SEQ ID NO: 794530 - protein, 398 aa, Homo sapiens; identical to SEQ ID NO: 794507

SEQ ID NO: 794531 - protein, 462 aa, Homo sapiens; identical to SEQ ID NO: 794508

SEQ ID NO: 794532 - protein, 453 aa, Homo sapiens
LLEQNHRLVQSHEAKCRIANIWLYSYRGSLGLNTGLKLMISLTALGRTDRIQLCNNILVGHHVRVVIKLVVLVHEDVKADGLNDQSYGSLCGILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 794533 - protein, 450 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGPHGSSAPCGRIAAFGWNRRPDLGLGVLAPWRYIAFLGT

SEQ ID NO: 794534 - protein, 396 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTGALRQRPTCSSS

SEQ ID NO: 794535 - protein, 324 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRLTSEKETIPGRKSNEGSLLISQRVSCPRRRNQISSP

SEQ ID NO: 794536 - protein, 436 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 794537 - protein, 238 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFLC

SEQ ID NO: 794538 - protein, 206 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRSDVH

SEQ ID NO: 794539 - protein, 163 aa, Homo sapiens
MSTEKVDQKEEAGEKEVCGDQIKGPDKEEEPPAAASHGQGWRPGGRAARNARPEPGARHPALPAMVNDPPVPALLWAQEVGQVLAGRARRLLLQFGVLFCTILLLLWVSVFLYGSFYYSYMPTVSHLSPVHFYYRTDCDSSTTSLCSFPVSDSAALGSSRISR

SEQ ID NO: 794540 - protein, 144 aa, Homo sapiens
MAPQKDRKPKRSTWRFNLDLTHPVEDGIFDSGNFGTFPSEYLGFSSLVLHFFCFKKEQFLREKVKVNGKTGNLGNVVHIERFKNKITVVSEKQFSKRYLKYLTKKYLKKNNLRDWLRVVASDKETYELRYFQISQDEDESESED

SEQ ID NO: 794541 - protein, 276 aa, Homo sapiens
AEWERAPGRPGRMRYRASALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSD

SEQ ID NO: 794542 - protein, 248 aa, Homo sapiens
MESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSD

SEQ ID NO: 794543 - protein, 272 aa, Homo sapiens
MIRPPRPPKALGLQALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSD

SEQ ID NO: 794544 - protein, 61 aa, Homo sapiens
MVFPALKNDSKGSGAQDVTFLIHITTFRVFIGNEEMLLVRRNRVCKSERTVEAFNTCFPEK

SEQ ID NO: 794545 - protein, 124 aa, Homo sapiens
VPGAAALAPGRFRGAILPNLPTPWASLSLFLVPPHPNNSYSSTRYTGLLTGTFGKCPSPSPLSGATSLSLLPHRCWGVPCLHSQPQSHKYIIYAQASPYAQARRAALLPTADTFGFWRGKGSCS

SEQ ID NO: 794546 - protein, 75 aa, Homo sapiens
MFRWEGKETISVNLMCQVRKPRVLSTGPNFSTKSGSGQPFELSKLTYLHPNLWVSFASGLLTGKSPERLSQYLLF

SEQ ID NO: 794547 - protein, 123 aa, Homo sapiens
LQYSTSNKGRTTRHKTNKETKDSNNTVEQLDLTDIYRTLHLTSAEYTFFSSAHRLCSRIELMLSHKTSLNKFKKIVIIPGIFCDQNGIQPEINSGRKMRRVSNVWKLNNILVRRRKEIIKNTT

SEQ ID NO: 794548 - protein, 128 aa, Homo sapiens
VSLCTAKGIIIRVNRQPTERKKVFANYASNVKNPQGTQTNHQEKHNPIKKRANGPGVVAHACNLSTLGGQGGQIMRSGDRDHPGQHGETPSLLKIQKISRVWWQAPVVPATREAEAREWCEPGRRSLQ

SEQ ID NO: 794549 - protein, 207 aa, Homo sapiens
VNPASRPHYASAIPVPRASSQTRIPTPGASPQLRPRQAGLALSPQRAASPRLGKAAGPSRNSSPRAFRGRGSPKFAGAVRESAEDGEGPFSSPWNSPRTTPKAALSSRAGSGRIGERQGTQGKKKKAQEGTPVCQTRGRSPSRTSFHGETQIPGAPEGRKPPSCPGKDQRDINYKSSGTPRSLEPDEGAASWASSPVCSPVQGKRPS

SEQ ID NO: 794550 - protein, 109 aa, Homo sapiens
MFWEYFGQQTDLLLVTCCQSVYDKTEQAERVYMGAHRMCRGEQTVSLWLERDTKPTSKGSEGQVSPGTPQSGRRRQKHLGWGDVIPWLEGQSLQVGRRGREFSSSSRRP

SEQ ID NO: 794551 - protein, 396 aa, Homo sapiens
IAPEAFPSEDLHNKTLSQQTCKSHVDTEKPYPASIPELASTEMIKVKNHSVLQRTEKKVLPSPLELSVFSEGTDNKGNELPSAKLQDKQYISSVDKAPFSEGSRNKTHKQGSTQSRLETSHTSKSSEPSKSPDGIRNESRDSEISKRKTAEQHSFGICKEKRARIEDDQSTRNISSSSPPEKEQPPREEPRVPPLKIQLSKIGPPFIIKSQPVSKPESRASTSTSVSGGRNTGARTLADIKARAQQARAQREAAAAAAVAAAASIVSGAMGSPGEGGKTRTLAHIKEQTKAKLFAKHQARAHLFQTSKETRLPPPLSSKEGPPNLEVSSTPETKMEGSTGVIIVNPNCRSPSNKSAHLRETTTVLQQSLNPSKLPETATDLSVHSSDENITCVTFI

SEQ ID NO: 794552 - protein, 319 aa, Homo sapiens
MSCERKGLSELRSELYFLIARFLEDGPCQQAAQVLIREVAEKELLPRRTDWTGKEHPRTYQNLVKYYRHLAPDHLLQICHRLGPLLEQEIPQSVPGVQTLLGAGRQSLLRTNKSCKHVVWKGSALAALHCGRPPESPVNYGSPPSIADTLFPRKLNGKYRLERLVTTAVYQHCNCISEFLDTWSSCVLVLTFDTNTGRTDLHRHPHDLVLVPHMGQHARREGSSDNLHTNSKRHTRTGRYTFIIPVHPVKLGEQLDPPRRLNHQMHDMRTHEASGLVAHKDTHMRSEQTDYSPGEAQSVPDPPKTRYTTRHETTSTYLS

SEQ ID NO: 794553 - protein, 138 aa, Homo sapiens
MSCERKGLSELRSELYFLIARFLEDGPCQQAAQVLIREVAEKELLPRRTDWTGKEHPRTYQNLVRHSRRKQRNFSLSRIKIEFPAIFYRDKNLALERESSKGHGEGWEAGAGSAGASGRGYSYFGAAGAADNLFVIFC

SEQ ID NO: 794554 - protein, 304 aa, Homo sapiens
YGVYSSSPVWRWTCSRRSGADTRGGEKELLPRRTDWTGKEHPRTYQNLVKYYRHLAPDHLLQICHRLGPLLEQEIPQSVPGVQTLLGAGRQSLLRTNKSCKHVVWKGSALAALHCGRPPESPVNYGSPPSIADTLFPRKLNGKYRLERLVTTAVYQHCNCISEFLDTWSSCVLVLTFDTNTGRTDLHRHPHDLVLVPHMGQHARREGSSDNLHTNSKRHTRTGRYTFIIPVHPVKLGEQLDPPRRLNHQMHDMRTHEASGLVAHKDTHMRSEQTDYSPGEAQSVPDPPKTRYTTRHETTSTYLS

SEQ ID NO: 794555 - protein, 116 aa, Homo sapiens
HGKPLPHCRDSGLAPGASSSTASSTVLFTVHRMCFPRMQAAAAAGKETTPSSPGCQHWETTGKAPALKGAELDKSSDIVQSSEDFLFFQRLTQKTSSLFSLTTDENRKEGEADFEW

SEQ ID NO: 794556 - protein, 102 aa, Homo sapiens
MFRGSQNGKRCSKGTELLKGVEAALPWVTRGKLETCDIQAVSGRIGHALWQIAPSSSLLLPAPPNSTLGGSTWDHLRGGLVAVTQSQMSAQTWRLQRAGALP

SEQ ID NO: 794557 - protein, 178 aa, Homo sapiens
MERIVHCEGIVSWDNLYREYNTMASTFGPKDILVLPLATDSFFVIGKVTSSLWASVSSFLNNKKIPHGAWLLSPCLHFLQALLVCAQVYLPLPVRSLLCICTCPPFVCSLSDTGLPLFPPTASLNPAMCHNGVELSFWMMWRDLTLMPFPSHQANLASSSTHGISQNAESGREIEHQG

SEQ ID NO: 794558 - protein, 1523 aa, Homo sapiens
MGSGGSVGPLWFDTAYGPHLAWEPLLLGKLRPISSCPHPQWQLEEWPEGEAGIGGLQCHHPQIPAVAPANPWRWGMARQVLHRSPSTRALRRRNLSRDRSGLVVILQKLHSSGLGPPSQVIRPVMFPFGPGRGARPGRETPLGPRGGESELAEASGSRNLQGGDLSCWEFLGLTSCQVKVWAGHKVRLCLLVPGPRKCWDLGSAQRQHRWQNHEGAPARTPFCNPPIPPCSTSPPPGKNLSLDHSSLSHTASFFGENHPEVTVAMALTDIDLQLQFSMSQPEALLLLAAGPADHLLLQLYSGHLQVRLVLGQEELRLQTPAEILLSDSVPHTTVLTVSEDWPTLSVNGFLNASSVVLGAPLEVPYGLFVGSTGRLGLPYLRGTSHPLRGCLHAAALNGRRLLQPLTPNKHEGCAEEFSANDDVALGFSGSHSLAALPAWGTQDEGTLEFTLTTQSWQAPLAFQAAGWHGDFIHVDIFEGHLWSMVEKGQGTVLLLNSVPVTDAQPHKVSIHINIHQLEISMDQYPTRTEESSATWSHVTVSFLGSWLQRPLITSRNTASGLTPGAANASLLGWLHGRPQCQWLEAGAVGSLLTHNMVAGCRLEEVDNAYGHYEAFSTLAPKAWLSVELAEPCVPEPGLPPVFANFIQLLISAVVVTEGGTAWLEWWHVQPMLALMEAELRKSQVLFSVTCGAHYSELELDVLGAQAGKMFTLLDVVNCKARFIHDGPEDTSDQLVLEVSVMAWLPMPSCLRRGQTDLLPIQVNPVNDPPHIIFPHGSLMVILEHTQKPLGPEVLQAYDLDSACEGLAFQLLGTPSGLPVDHRDQPGEPVTEFSCWELEAGSLVYVHCGGPTQDLTFRVSNGLQASPPAMLKVVAVQLAIQIHRSTGLHLAQGSAMPILPTNLLVETSAVGQDVTVLFHVTGGLPFRELQKQGAGGVEDAEWWVTQAFHQQDVEQGHVRYRSTDPQHYTEDTVENLDLQVQVSWEILSNLSFLVTIQRATVWMLQLEPLHTQNTQQEALTTAHLEATLEEAGPSPPTFHCEVVQAPRKGNFQLQGTMLSDGQGFTQDDVQAAEVTYGAMARASVAVEDTFCFHVTAPPYFSPLCTFSIHIGGDPDMPVLTNVLVVPEGGGCVLSADQLFVKSLNSARYLYEVMEQPCHGRFLAWDTGQDHYGDILHQWRPVAWPAGLQHDDSEITEDDMPFAAAARTRAVVTWPGRRYGAIQPVNDHAPVQSISCVFHVAWGRWQLLTTDNMAFSNADSGFVDAQLVLTHKDLLSGSIMATDEPMQPICCFIQEGPQEEASPVHALRLTTAGSCCRCPTGSTRPSWCWRCRPWSLTSVWPFSLATMAASAPATPWPSQWMWGLLMDVGPVHTDATLQVTIALEGPLAPLKLAWHKKIYIFQGEAAEIRRDQLETTEFIISEPLANMYSRGNQNTLMEEWAEEAQWHDEMLRMHHVLKEALSIISDTTRTTVSMPMPLPADDTWVQVQSISEEQRCQGLPPTAPKYPPPGPHRGMPLHRGGSHLE

SEQ ID NO: 794559 - protein, 52 aa, Homo sapiens
MWLKGSDVYLSVAGRSDNTGRERELGLSRHRKQHMRSPELHLVQNLAAWASG

SEQ ID NO: 794560 - protein, 123 aa, Homo sapiens
MLVVQQLILFLLSLMWKLSPGTEPAPWVQTLPQPLLEFWALGTALDLSEQVHFFIHKTGLEWPPPHGNVAWIKYGNALTEGAAGVVHYSNTEKRIVRHQHVLELSRRGMKQVVELVASLPNAT

SEQ ID NO: 794561 - protein, 37 aa, Homo sapiens
MAVVATLRLSAQVIVVPSMPSGHLIITQKPVVLQGRV

SEQ ID NO: 794562 - protein, 271 aa, Homo sapiens
METNCRKLVSACVQLEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 794563 - protein, 317 aa, Homo sapiens
METNCRKLVSACVQLGVQPAAVECLFSKDSEIKKVEFTDSPESRKEAASSKFFPRQHPGANEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 794564 - protein, 107 aa, Homo sapiens
STWICQCSLGAPTGQALGEVLGHKSTSSNACLNPLPWRPHPSCSMSGLWPLGEVKQLARGQRLPEGLQLQEHWQIQVDEAVKRKLVSPPLITSLGQGYSWCYLAPFS

SEQ ID NO: 794565 - protein, 115 aa, Homo sapiens
MQGEQNISSRTAEGTRYLCPWKELRGKFICCIFARLMFAKQGTLPTFPQNQSEGDSTLFPSPPLKQLSNHVEQTAVCQLVEAKQIIWNSDQQNGICSHTMIKTYLRPHYLWGKEV

SEQ ID NO: 794566 - protein, 175 aa, Homo sapiens
TYVKYPTPCPTYVKCPASLPDQPNVKCPTPCQTYVKCPAPCQMTYIKSPAPCQTQTCYVQGASPCQSYYVQAPASGSTSQYCVTDPCSAPCSTSYCCLAPRTFGVSPLRRWIQRPQNCNTGSSGCCENSGSSGCCGSGGCGCSCGCGSSGCCCLGIIPMRSRGPACCDHEDDCCC

SEQ ID NO: 794567 - protein, 198 aa, Homo sapiens
MELPDPVRQRLGNFSRAVFSDSNRTSPESNEGPENEMVSSLALQMSLYFNTYYFPLWWVSSIMMLHMKYSILPDYYKFIVITVIILITLIEAIRLYLGYVGNLQEKVPELAGFWLLSLLLQLPLILFLLFNEGLTNLPLEKAIHIIFTLFLAFQVVAAFLTLRKMVNQLAVRFHLQDFDRLSANRGDMRRMRSCIEEI

SEQ ID NO: 794568 - protein, 69 aa, Homo sapiens
KLCSVLVLTSGPGRVVLVSSPDRFPCRQVARRVFCSQSAVLLLKVSATVSVYHAGLLLVHPGSGLFASS

SEQ ID NO: 794569 - protein, 88 aa, Homo sapiens
MTVACSVYVCGVVELPRFVVLLCVCVLYRAVVKSDTITLQNIVFIHSKFIEKSHAIILKLCDYFTKLDLQKRTISYPKSCYGYMQHVL

SEQ ID NO: 794570 - protein, 131 aa, Homo sapiens
ESFARSLIQRNVLMRRDIPNLTKYQIILARDQFRKNPSPNIVGIQQGIIEGEFAICISLYHGYELLQQMGMRSLYFFLCGIMDGTKGMTRSKNELGRNEDFMKLYNHLECMFARTRSTSANGISAIQQGLV

SEQ ID NO: 794571 - protein, 333 aa, Homo sapiens
MAVRGANTLTSFSIQAILNKKEERGGLAAPEGRPAPGGTAASVAAAPAVCCWRLFGERDAGALGGAEDSLLASPAGTRTAAGRTAESPEGWDSDSALSEENESRRRCADARGASGAGLAGGSLSLGQPVCELAASKDLEEEAAGRSDSEMSASVSGDRSPRTEDDGVGPRGAHVSALCSGAGGGGGSGPAGVAEEEEEPAAPKPRKKRSRAAFSHAQVFELERRFNHQRYLSGPERADLAASLKLTETQVKIWFQNRRYKTKRRQMAADLLASAPAAKKVAVKVLVRDDQRQYLPGEVLRPPSLLPLQPSYYYPYYCLPGWALSTCAAAAGTQ

SEQ ID NO: 794572 - protein, 67 aa, Homo sapiens
EWRRRVISTAAKLSHAIFPDSTLIMMKEQDFFFPVFTEEARGGGKGGGSERDVSCQGTECKAAVTAK

SEQ ID NO: 794573 - protein, 1158 aa, Homo sapiens
MTHGEELGSDVHQDSIVLTYLEGLLMHQAAGGSGTAVDKKSAGHNEEDQNFNISGSAFPTCQSNGPVLNTHTYQGSGMLHLKKARLLQSSEDWNAAKRKRLSDSIMNLNVKKEALLAGMVDSVPKGKQDSTLLASLLQSFSSRLQTVALSQQIRQSLKEQGYALSHDSLKVEKDLRCYGVASSHLKTLLKKSKVKDQKPDTNLPDVTKNLIRDRFAESPHHVGQSGTKVMSEPLSCAARLQAVASMVEKRASPATSPKPSVACSQLALLLSSEAHLQQYSREHALKTQNANQAASERLAAMARLQENGQKDVGSYQLPKGMSSHLNGQARTSSSKLMASKSSATVFQNPMGIIPSSPKNAGYKNSLERNNIKQAANNSLLLHLLKSQTIPKPMNGHSHSERGSIFEESSTPTTIDEYSDNNPSFTDDSSGDESSYSNCVPIDLSCKHRTEKSESDQPVSLDNFTQSLLNTWDPKVPDVDIKEDQDTSKNSKLNSHQKVTLLQLLLGHKNEENVEKNTSPQGVHNDVSKFNTQNYARTSVIESPSTNRTTPVSTPPLLTSSKAGSPINLSQHSLVIKWNSPPYVCSTQSEKLTNTASNHSMDLTKSKDPPGEKPAQNEGAQNSATFSASKLLQNLAQCGMQSSMSVEEQRPSKQLLTGNTDKPIGMIDRLNSPLLSNKTNAVEENKAFSSQPTGPEPGLSGSEIENLLERRTVLQLLLGNPNKGKSEKKEKTPLRDESTQEHSERALSEQILMVKIKSEPCDDLQIPNTNVHLSHDAKSAPFLGMAPAVQRSAPALPVSEDFKSEPVSPQDFSFSKNGLLSRLLRQNQDSYLADDSDRSHRNNEMALLESKNLCMVPKKRKLYTEPLENPFKKMKNNIVDAANNHSAPEVLYGSLLNQEELKFSRNDLEFKYPAGHGSASESEHRSWARESKSFNVLKQLLLSENCVRDLSPHRSNSVADSKKKGHKNNVTNSKPEFSISSLNGLMYSSTQPSSCMDNRTFSYPGVVKTPVSPTFPEHLGCAGSRPESGLLNGCSMPSEKGPIKWVITDAEKNEYEKDSPRLTKTNPILYYMLQKGGNSVTSRETQDKDIWREASSAESVSQVTAKEELLPTAETKASFFNLRSPYNSHMGNNASRPHSANGEVYGLLGSVLTIKKESE

SEQ ID NO: 794574 - protein, 1158 aa, Homo sapiens; identical to SEQ ID NO: 794573

SEQ ID NO: 794575 - protein, 1158 aa, Homo sapiens; identical to SEQ ID NO: 794573

SEQ ID NO: 794576 - protein, 1158 aa, Homo sapiens; identical to SEQ ID NO: 794573

SEQ ID NO: 794577 - protein, 95 aa, Homo sapiens
FHGPLAMPRGSTGFLLVLMSCGVNSRRLLRTEAETGDQDGIVWLQEATQSQEAASKRPTWPAWGCAWLSSMWSFELYMFHWDAYRKVDRRCGKSF

SEQ ID NO: 794578 - protein, 56 aa, Homo sapiens
MYHICVHEGPGCRTGGRRVSEETALEADSTVLRVKFRLSICSVALGLDSQVEWECK

SEQ ID NO: 794579 - protein, 196 aa, Homo sapiens
KPASTYSTSQPSMAPLLPIRTLPLILILLALLSPGAADFNISSLSGLLSPALTESLLVALPPCHLTGGNATLMVRRANDSKVVTSSFVVPPCRGRRELVSVVDSGAGFTVTRLSAYQVTNLVPGTKFYISYLVKKGTATESSREIPMSTLPRRNMESIGLGMARTGGMVVITVLLSVAMFLLVLGFIIALALGSRK

SEQ ID NO: 794580 - protein, 154 aa, Homo sapiens
SNWISLLAPLLAWHDFRLAPSPPLTSRGLGGPHARPELDAMTSIFQPQVSRIEVPPLPNGPTFDFNISSLSGLLSPALTESLLVALPPCHLTGGNATLMVRRANDSKVVTSSFVVPPCRGRRELVSVVDSGAGFTVTRLSAYQHFLPSEEGDSH

SEQ ID NO: 794581 - protein, 174 aa, Homo sapiens
KTDKSSLNLPEVDSDVAKPNQACISTVTAEDLLRSSISFPSGKKIGVLSLESLHASTRSSARQALGITIVRQPGRRGTGDLQLEPFLYFIVSQPSLLLSCHHRKQRVEVSIFDAVLKGVASDYKCIGKNLQTYWSANNYYLISCIPIVSRLIKQKQLADKSLFSTEYGKFMFHS

SEQ ID NO: 794582 - protein, 160 aa, Homo sapiens
KTDKSSLNLPEVDSDVAKPNQACISTVTAEDLLRSSISFPSGKKIGVLSLESLHASTRSSARQALGITIVRQPGRRGTGDLQLEPFLYFIVSQPSLLLSCHHRKQRVEVSIFDAVLKGVASDYKCIDPGKTLPEALDYCTVWLQTVPGEIDSKSGIPPSF

SEQ ID NO: 794583 - protein, 120 aa, Homo sapiens
MACWEKMKQWWRYCRTGKTGTFQKLKYIIKISRFSKSVLNSYCLSACGNSVGLFKLQLEFKLPRSHTLPSVRSMIYVCVTSRAYCRAIGSLERKYKYTPCPCDIHIPPQNLLSVSFKHLC

SEQ ID NO: 794584 - protein, 152 aa, Homo sapiens
FLQAPLWSTLPGKHSLWHMSSQDSTSLPPSWKPPVCCRGFPSLLHTLVRTRQSLLKDIDAVPQCHMLAASCLVLLEPHLHANPSLGHRMEPSARLPGASGAHHLLRDVCWCLCVPPLRMPAPSRQGLPNSVPDCDPGTQSSARHTAGAQETC

SEQ ID NO: 794585 - protein, 103 aa, Homo sapiens
LAPPSALRTRIPPNLNARLSGPEGLEGRGNDAALQSWTPWRAAATAGCSLPPEVLPFPAEALHSGRPRRSDVSLYPEFSAGGKTTCTRGGSGFAGRAHGSAPC

SEQ ID NO: 794586 - protein, 103 aa, Homo sapiens
PRVGSTAPKRGTRNRTKTSPAPKAEGTKKGEWSMKDFDGGDGLISGSGSHGTSFRTLKGVDRTGGIWGPWVFKAAVFDGTLSGEALGPGAMRPFGDRFSGAVT

SEQ ID NO: 794587 - protein, 75 aa, Homo sapiens
VHSAEARAGSRGNGFSESGRCSPKDTSPMEMVCRNGRMAGVNCGETRLRHPPLKRGMGTGQERGTGMCGEDTFIQ

SEQ ID NO: 794588 - protein, 81 aa, Homo sapiens
GGRRSSSSKRQRWRAGPAVSVTVLPEGHQPNGDGLQEWPDGRRELWRDAAASPTAQERDGDRAGARHRDVRGRHIHSVNVS

SEQ ID NO: 794589 - protein, 101 aa, Homo sapiens
TTTKFAAASTAGGSSRFTSSSSRKSHFQLDVWMNYWKLLSVLQQLDYHTNESTQMLASGAESQDRYRNTPSSRIFTPGFRPTPATTPEPGIYMFNMEPSQP

SEQ ID NO: 794590 - protein, 141 aa, Homo sapiens
ETVFGKRGHVLGNGSQVTQAANSGCSKAIGALASSRRSSSEGLSKGKKAANGLEADNSCPNSKAPVLSKYPYSCRSQENILQGFSTSHKEGVNQPAAVVMEDSSPHEALRCRVIKSSGREKPDSDDDLDIASLVTAKLVNT

SEQ ID NO: 794591 - protein, 91 aa, Homo sapiens
PPGRPHQLPARLWDLIASVLGCVQESGAQWVGMAVPGVLDGHPAPIIPEIRLHLHLGAGPVTASSRALWRAPWDNRAGLAGESPGAIPEGS

SEQ ID NO: 794592 - protein, 115 aa, Homo sapiens
CFPDLLTARDLDPASQRHSREMGSCAGGICPAVQCSGTTSFGANSPDIDFLSLRRQPRQCIPGINALNSSFPILGQSDVTQSQRLGQRILQPQIAAEFTVPWGGLILQGCFLCHF

SEQ ID NO: 794593 - protein, 106 aa, Homo sapiens [sequence omitted]

SEQ ID NO: 794594 - protein, 473 aa, Homo sapiens
LSKVPRPLLHFSRLTLEEELFGNNEESPAFKEFLDLLGDTITLQDFKGFRGGLDVTHGQTGVESVYTTFRDREIMFHVSTKLPFTDGDAQQLQRKRHIGNDIVAIIFQEENTPFVPDMIASNFLHAYIVVQVETPGTETPSYKVSVTAREDVPTFGPPLPSPPVFQKGPEFREFLLTKLTNAENACCKSDKFAKLEDRTRAALLDNLHDELHAHTQAMLGLGPEEDKFENGGHGGFLESFKRAIRVRSHSMETMVGGQKKSHSGGIPGSLSGGISHNSMEVTKTTFSPPVVAATVKNQSRSPIKRRSGLFPRLHTGSEGQGDSRARCDSTSSTPKTPDGGHSSQEIKSETSSNPSSPEICPNKEKPFMKLKENGRAISRSSSSTSSVSSTAGEGEAMEEGDSGGSQPSTTSPFKQEVFVYSPSPSSESPSLGAAATPIIMSRSPTDAKSRNSPRSNLKFRFDKLSHASSGAGH

SEQ ID NO: 794595 - protein, 407 aa, Homo sapiens
APGIHVHGSGRTSGWRGAVGSWVRGCGAGAEGRAGIHSSFCSSTTRVELWQWWDDPGRRAGGVEQEAEHAAFILAAAFVSTKLSSAVGPHRCWAGLGRMSASRPGVWSSQGAGTSLLSEPASPSPPSSLLDRTRAALLDNLHDELHAHTQAMLGLGPEEDKFENGGHGGFLESFKRAIRVRSHSMETMVGGQKKSHSGGIPGSLSGGISHNSMEVTKTTFSPPVVAATVKNQSRSPIKRRSGLFPRLHTGSEGQGDSRARCDSTSSTPKTPDGGHSSQEIKSETSSNPSSPEICPNKEKPFMKLKENGRAISRSSSSTSSVSSTAGEGEAMEEGDSGGSQPSTTSPFKQEVFVYSPSPSSESPSLGAAATPIIMSRSPTDAKSRNSPRSNLKFRFDKLSHASSGAGH

SEQ ID NO: 794596 - protein, 211 aa, Homo sapiens
LSKVPRPLLHFSRLTLEEELFGNNEESPAFKEFLDLLGDTITLQDFKGFRGGLDVTHGQTGVESVYTTFRDREIMFHVSTKLPFTDGDAQQLQRKRHIGNDIVAIIFQEENTPFVPDMIASNFLHAYIVVQVETPGTETPSYKVSVTAREDVPTFGPPLPSPPVFQKCAWVRTQAHFWELLMNVKRGTYLPQTYIIQEEMVSRSMSVTRRR

SEQ ID NO: 794597 - protein, 178 aa, Homo sapiens
LSKVPRPLLHFSRLTLEEELFGNNEESPAFKEFLDLLGDTITLQDFKGFRGGLDVTHGQTGVESVYTTFRDREIMFHVSTKLPFTDGDAQQLQRKRHIGNDIVAIIFQEENTPFVPDMIASNFLHAYIVVQVETPGTETPSYKVSVTAREDVPTFGPPLPSPPVFQKCAWVRGVLYSD

SEQ ID NO: 794598 - protein, 804 aa, Homo sapiens
EFESSSESSPSSSEDEEEVVAREEEEEEEEEEMVAEESMASAGPEDFEQDGEEAALAPGAPAVDSLGMEEEVDIETEAVAPEERPSMLDEPPLPVGVEEPADSREPPEEPGLSQEGAMLLSPEPPAKEVEARPPLSPERAPEHDLEVEPEPPMMLPLPLQPPLPPPRPPRPPSPPPEPETTDASHPSVPPEPLAEDHPPHTPGLCGSLAKSQSTETVPATPGGEPPLSGGSSGLSLSSPQVPGSPFSYPAPSPSLSSGGLPRTPGRDFSFTPTFSEPSGPLLLPVCPLPTGRRDERSGPLASPVLLETGLPLPLPLPLPLPLALPAVLRAQARAPTPLPPLLPAPLASCPPPMKRKPGRPRRSPPSMLSLDGPLVRPPAGAALGRELLLLPGQPQTPVFPSTHDPRTVTLDFRNAGIPAPPPPLPPQPPPPPPPPPVEPTKLPFKELDNQWPSEAIPPGPRGRDEVTEEYMELAKSRGPWRRPPKKRHEDLVPPAGSPELSPPQPLFRPRSEFEEMTILYDIWNGGIDEEDIRFLCVTYERLLQQDNGMDWLNDTLWVYHPSTSLSSAKKKKRDDGIREHVTGCARSEGFYTIDKKDKLRYLNSSRASTDEPPADTQGMSIPAQPHASTRAGSERRSEQRRLLSSFTGSCDSDLLKFNQLKFRKKKLKFCKSHIHDWGLFAMEPIAADEMVIEYVGQNIRQVIADMREKRYEDEGIGSSYMFRVDHDTIIDATKCGNFARFINHSCNPNCYAKVITVESQKKIVIYSKQHINVNEEITYDYKFPIEDVKIPCLCGSENCRGTLN

SEQ ID NO: 794599 - protein, 822 aa, Homo sapiens
RTSADMRDQDTGKENEMDWDDSALTITVNPMETYEDQHSSEEEEEEEEEEMVAEESMASAGPEDFEQDGEEAALAPGAPAVDSLGMEEEVDIETEAVAPEERPSMLDEPPLPVGVEEPADSREPPEEPGLSQEGAMLLSPEPPAKEVEARPPLSPERAPEHDLEVEPEPPMMLPLPLQPPLPPPRPPRPPSPPPEPETTDASHPSVPPEPLAEDHPPHTPGLCGSLAKSQSTETVPATPGGEPPLSGGSSGLSLSSPQVPGSPFSYPAPSPSLSSGGLPRTPGRDFSFTPTFSEPSGPLLLPVCPLPTGRRDERSGPLASPVLLETGLPLPLPLPLPLPLALPAVLRAQARAPTPLPPLLPAPLASCPPPMKRKPGRPRRSPPSMLSLDGPLVRPPAGAALGRELLLLPGQPQTPVFPSTHDPRTVTLDFRNAGIPAPPPPLPPQPPPPPPPPPVEPTKLPFKELDNQWPSEAIPPGPRGRDEVTEEYMELAKSRGPWRRPPKKRHEDLVPPAGSPELSPPQPLFRPRSEFEEMTILYDIWNGGIDEEDIRFLCVTYERLLQQDNGMDWLNDTLWVYHPSTSLSSAKKKKRDDGIREHVTGCARSEGFYTIDKKDKLRYLNSSRASTDEPPADTQGMSIPAQPHASTRAGSERRSEQRRLLSSFTGSCDSDLLKFNQLKFRKKKLKFCKSHIHDWGLFAMEPIAADEMVIEYVGQNIRQVIADMREKRYEDEGIGSSYMFRVDHDTIIDATKCGNFARFINHSCNPNCYAKVITVESQKKIVIYSKQHINVNEEITYDYKFPIEDVKIPCLCGSENCRGTLN

SEQ ID NO: 794600 - protein, 188 aa, Homo sapiens
RRDSRRHVTSSQPPLPATQIRPRNPCPAGRAGGHVAGAPVPAAPWCMYLWRSSPLGSLITGNNQRFRDHPGENEHTRPQTSSSAAVISGTAIPAAAGKFSWPRDAVSPKDTWIATFGPSDNVFMYLKSFKERIASCFFSRQPLHPAPRSPSRPLITQSVEKQKATFTFLHRNNGRTQGVAFWSQGSSG

SEQ ID NO: 794601 - protein, 219 aa, Homo sapiens
RRDSRRHVTSSQPPLPATQIRPRNPCPAGRAGGHVAGAPVPAAPWCMYLWRSSPLGSLITGNNQRFRDHPGENEHTRPQTSSSAAVISGTAIPAAAGKFSWPRDAVSPKDTWIATFGPSDNVFMYLKSFKERIASCFFSRQPLHPAPRSPSRPLISEQTSLQNFLWDSSLPTANSLFTSFLWFKPTAQSVEKQKATFTFLHRNNGRTQGVAFWSQGSSG

SEQ ID NO: 794602 - protein, 91 aa, Homo sapiens
VEGAGFSIDRLAEFSKEDDEYEAFRKKMMLAYRFRPNPLNIPDGLTTERSGNTYFLNDHPSLDCGMFRPAFLPPPSVVTSAMPCNKVPVFF

SEQ ID NO: 794603 - protein, 104 aa, Homo sapiens
RLECSGACNLGSPQPPPPGFKQFSYLILPSTWDYRHVPPHPANFLFFVEMGFLHVGHAGLELLTSSIHPTTPRLPKWWNYRHEPPCPAQLCFFSIYVSMTPKFV

SEQ ID NO: 794604 - protein, 108 aa, Homo sapiens
KKCLRMTDVAGWLCQRWGGMPSERDAGQSAACDISSRSSVMALVVHDMLCTFFLDPKYFIIIVFKNKVSGWARWLTLVIPALWEAEAGGSRGQEIETILANMVKPRLY

SEQ ID NO: 794605 - protein, 104 aa, Homo sapiens [sequence omitted]

SEQ ID NO: 794606 - protein, 97 aa, Homo sapiens
MHIYQAALFRIVPSGNNTNILRLLNGRRPCEAFTRRHCKASMRQPALRSQGTGLWQTRHRGGISTAEWTETLRGLHETASTWESRQRPLSDMPPWGN

SEQ ID NO: 794607 - protein, 221 aa, Homo sapiens
ARRPHREPGGNMAAPGGRGRSLSGLLPAQTSLEYALLDAVTQQEKDSLVYQYLQKVDGWEQDLSVPEFPEGLEWLNTEEPISVYKDLCGKIVVLDFFTYCCINCIHLLPDLHALEHTYSDKDGLLIIGVHSAKFPNEKVLDNIKSAVLRYNITHPMVNDADASLWQELEVSCWPTLVILGPRGNMLFSLIGEGHKDKLFLYTSIALKFYKDRGRSEIIKLG

SEQ ID NO: 794608 - protein, 129 aa, Homo sapiens
ARRPHREPGGNMAAPGGRGRSLSGLLPAQTSLEYALLDAVTQQEKDSLVYQYLQKVDGWEQDLSVPEFPEGLEWLNTEEPISVYKDLCGKIVVLDFFTYCCINCIHLLPDLHALEHTYSDKGICSLISF

SEQ ID NO: 794609 - protein, 538 aa, Homo sapiens
GAAAGKPGHCWLQQDIPGTAPRALSRHPSPLTHLQMLSQLAMLQGSLLLVVATMSVAQQTRQEADRGCETLVVQHGHCSYTFLLPKSEPCPPGPEVSRDSNTLQRESLANPLHLGKLPTQQVKQLEQALQNNTQWLKKLERAIKTILRSKLEQVQQQMAQNQTAPMLELGTSLLNQTTAQIRKLTDMEAQLLNQTSRMDAQMPETFLSTNKLENQLLLQRQKLQQLQGQNSALEKRLQALETKQQEELASILSKKAKLLNTLSRQSAALTNIERGLRGVRHNSSLLQDQQHSLRQLLVLLRHLVQERANASAPAFIMAGEQVFQDCAEIQRSGASASGVYTIQVSNATKPRKVFCDLQSSGGRWTLIQRRENGTVNFQRNWKDYKQGFGDPAGEHWLGNEVVHQLTRRAAYSLRVELQDWEGHEAYAQYEHFHLGSENQLYRLSVVGYSGSAGRQSSLVLQNTSFSTLDSDNDHCLCKCAQVMSGGWWFDACGLSNLNGVYYHAPDNKYKMDGIRWHYFKGPSYSLRASRMMIRPLDI

SEQ ID NO: 794610 - protein, 491 aa, Homo sapiens
GAAAGKPGHCWLQQDIPGTAPRALSRHPSPLTHLQMLSQLAMLQGSLLLVVATMSVAQQTRQEADRGCETLVVQHGHCSYTFLLPKSEPCPPGPEVSRDSNTLQRESLANPLHLGKLPTQQVKQLEQALQNNTQWLKKLERAIKTILRSKLEQVQQQMAQNQTAPMLELGTSLLNQTTAQIRKLTDMEAQLLNQTSRMDAQMPETFLSTNKLENQLLLQRQKLQQLQGQNSALEKRLQALETKQQEELASILSKKAKLLNTLSRQSAALTNIERGLRGVRHNSSLLQDQQHSLRQLLVLLRHLVQERANASAPAFIMAGEQVFQDCAEIQRSGASASGVYTIQVSNATKPRKVFCDLQSSGGRWTLIQRRENGTVNFQRNWKDYKQGFGDPAGEHWLGNEVVHQLTRRAAYSLRVELQDWEGHEAYAQYEHFHLGSENQLYRLSVVGYSGSAGRQSSLVLQNTSFSTLDSDNDHCLCKCAQVMSGGRCRVG

SEQ ID NO: 794611 - protein, 103 aa, Homo sapiens
GTPQGSVTQASFCGVPAASWERGEKSKAGPHQTHRGNPHKKQWLSQAWGRLVERCIVPGRRGHRVLAECEESTQEASGRTSPLTAQYTCEHRCHRLPGRGVRT

SEQ ID NO: 794612 - protein, 375 aa, Homo sapiens [sequence omitted]

SEQ ID NO: 794613 - protein, 82 aa, Homo sapiens
YRLPLDTNLQLKLTTLTSEHAELSCSGSPATLVKLTCFQTKHFNSWHGRGDLGKQCWKRMERREEEEGRMKRASLAQRQDIW

SEQ ID NO: 794614 - protein, 149 aa, Homo sapiens
RSLPPPAPFSPRLARKAGNVEREQRTPRPTAIGDSVPPYSRPGAGCPPTRAESRELFQKRIPNPRQTRGEASVPDSKNGESRALLPAGHPRPRRPNPGPPKPFEQKTLVPPSLPHPRQCSKGAPASALSEATGARSRPPTQLGNHGSAG

SEQ ID NO: 794615 - protein, 113 aa, Homo sapiens
NSQYYRCTPPRSPNFFFQFLTEMWFLFIARSGLKFLSSNNPPASASQSAEITGLTHCTQHFVFYEMGSFPLSPKLECSGTAIAHFNFKLLASSNPPALGSIDAGVTGMSHHAP

SEQ ID NO: 794616 - protein, 47 aa, Homo sapiens
GRAPWWGGDGFAYQNGLGIRYSAGSLAPGLFRTALSVASRIQRREAE

SEQ ID NO: 794617 - protein, 105 aa, Homo sapiens
MAPTFLCVKAQVLPAVHKALHTLPCPFPALPSSLSPPRSLFWSHTGHPPCSSNTQVQSCLGALARAVPSSQENPLLPNIHTACSLSSFKSLLKCHQCLNFTMRSL

SEQ ID NO: 794618 - protein, 142 aa, Homo sapiens
STKMVELGLRGTKGAHIPMRNIQDVEAPCWSPMRCFCFTFGALQQGHLLQVDQLTSKDTFKCSGAMDSMCSLKFICWKLISKVTVLEYGPFGRLQPHEWINVNYKKGLWESVHSQVLLPYPFQCWGHSKAPSWNQRPNLLAP

SEQ ID NO: 794619 - protein, 116 aa, Homo sapiens
DNNLAGQLTDACEVPTSCQTHSKPPTETPYLDMGGVPQGGPANLCGPNSHSSPTHWPSTYYSPKMPLCTFQTQHFTCGFPPCHNTPPNIPDEGFPNPCKMGLKNPSFTKCALHHIL

SEQ ID NO: 794620 - protein, 1546 aa, Homo sapiens [sequence omitted]

SEQ ID NO: 794621 - protein, 118 aa, Homo sapiens
PTTAPQPPPTWPPASLSAESLPLPRGERSLQSGPGKAIFQSPTANTNTAEANFTDFHFEALPLSQNPSAREISSLETGKNKGDVKAARTSQSNMPATGTWTFISSPSTLQSCSCGVER

SEQ ID NO: 794622 - protein, 135 aa, Homo sapiens
MAWGRYCGHRKLPGTSVGDVGETGCGGRLERRKGAEEGTPALLASPRETRTPKAHGLPLLGLRFVGEQRAERAIGFDYLKLNEAAQVLGRKQPRRHKDASGICPLIIRSSCETYLSAARTLERPRGCPCPFRRGR

SEQ ID NO: 794623 - protein, 67 aa, Homo sapiens
AGPLAMGHGGLSPELQTDGCPGEGAGFSMDADKAGPDCRVPPVEMMAVVFLRVREPCGLHCDGWFMA

SEQ ID NO: 794624 - protein, 68 aa, Homo sapiens
GWGRQFHTGTVDVPSFIGIGKGTLQVSGFRVDIISRSRSGSAIKQAVGVAAGLAARGTAERKGQKRLG

SEQ ID NO: 794625 - protein, 100 aa, Homo sapiens
PEARSNCIRVISYHGEGFSKSGPVAQWITRLTTDQKILEAHGNKAMTALEGDQTSSIIPSATQDSTAEPQRTQLKEVFTRALTTEKWEVPSCCHTQPMAG

SEQ ID NO: 794626 - protein, 113 aa, Homo sapiens [sequence omitted]

SEQ ID NO: 794627 - protein, 131 aa, Homo sapiens
MFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYAREPFSEATALLLRHSWALPSRRPWGSFV

SEQ ID NO: 794628 - protein, 131 aa, Homo sapiens; identical to SEQ ID NO: 794627

SEQ ID NO: 794629 - protein, 163 aa, Homo sapiens
FAGRVDYGCEIDDQKGLCSGSSSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYAREPFSEATALLLRHSWALPSRRPWGSFV

SEQ ID NO: 794630 - protein, 131 aa, Homo sapiens; identical to SEQ ID NO: 794627

SEQ ID NO: 794631 - protein, 131 aa, Homo sapiens; identical to SEQ ID NO: 794627

SEQ ID NO: 794632 - protein, 131 aa, Homo sapiens; identical to SEQ ID NO: 794627

SEQ ID NO: 794633 - protein, 163 aa, Homo sapiens; identical to SEQ ID NO: 794629

SEQ ID NO: 794634 - protein, 121 aa, Homo sapiens
MFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYARASISLCCPGWTRTPELK

SEQ ID NO: 794635 - protein, 188 aa, Homo sapiens
MPELILYVAITLSVAERLVGPGHACAEPSFRSSRCSAPLCLLCSGSSSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYAREPFSEATALLLRHSWALPSRRPWGSFV

SEQ ID NO: 794636 - protein, 147 aa, Homo sapiens
MPELILSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYAREPFSEATALLLRHSWALPSRRPWGSFV

SEQ ID NO: 794637 - protein, 131 aa, Homo sapiens; identical to SEQ ID NO: 794627

SEQ ID NO: 794638 - protein, 151 aa, Homo sapiens
PTAEKTERGSSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYAREPFSEATALLLRHSWALPSRRPWGSFV

SEQ ID NO: 794639 - protein, 131 aa, Homo sapiens; identical to SEQ ID NO: 794627

SEQ ID NO: 794640 - protein, 188 aa, Homo sapiens; identical to SEQ ID NO: 794635

SEQ ID NO: 794641 - protein, 188 aa, Homo sapiens; identical to SEQ ID NO: 794635

SEQ ID NO: 794642 - protein, 188 aa, Homo sapiens; identical to SEQ ID NO: 794635

SEQ ID NO: 794643 - protein, 188 aa, Homo sapiens; identical to SEQ ID NO: 794635

SEQ ID NO: 794644 - protein, 188 aa, Homo sapiens; identical to SEQ ID NO: 794635

SEQ ID NO: 794645 - protein, 131 aa, Homo sapiens; identical to SEQ ID NO: 794627

SEQ ID NO: 794646 - protein, 131 aa, Homo sapiens; identical to SEQ ID NO: 794627

SEQ ID NO: 794647 - protein, 121 aa, Homo sapiens
MGFGSLKGFKWYKSYQSKKLYLLPASFSQSLSSLAVSCPLTSLVSSRSFQTSAISRDIDTAAKFIGAGAATVGVAGSGAGIGTVFGSLIIGYAREPFSEATALLLRHSWALPSRRPWGSFV

SEQ ID NO: 794648 - protein, 196 aa, Homo sapiens
MPELILYVAITLSVAERLVGPGHACAEPSFRSSRCSAPLCLLCSGSSSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYAREPFSEATALLLRHSWALPSRRTMGGGDGSFTWQRG

SEQ ID NO: 794649 - protein, 196 aa, Homo sapiens; identical to SEQ ID NO: 794648

SEQ ID NO: 794650 - protein, 173 aa, Homo sapiens
MPELILYVAITLSVAERLVGPGHACAEPSFRSSRCSAPLCLLCSGSSSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYAREPFSEATGRSCH

SEQ ID NO: 794651 - protein, 184 aa, Homo sapiens
MPELILYVAITLSVAERLVGPGHACAEPSFRSSRCSAPLCLLCSGSSSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYAGPSLSTALLYAFWLALGAMGSLLR

SEQ ID NO: 794652 - protein, 186 aa, Homo sapiens
SHVVPPGDKKLVALREEITELPAGVAAGVFFVGATTGIISAPRHVVDSTLYVGHRVREFVYYIVPLVRRALVDKSRAGGGGLVAPIVCRAPEMRVYVVSSLSRMVFPGVALDFSPAVDAPVVVETLRGPVAAGVIIIRPPLFVGPPWSQSGGRAVGGPPGGSFGGARPPLFFFFFFFFFFFFFFSY

SEQ ID NO: 794653 - protein, 194 aa, Homo sapiens
VARGPGKLLRGLSAAVFIAGRGVPVCGSPLLRDRKAAAVIYPPLLPNPIKWRSSGPGRRGAREPGGGGGKDGAKEGRTNGPSESGGFAFIYSRGFLFIFYFLWGLVSFSRLSRAAFKHDAGTAGVWNWIGLVALFQRAGQVLSGRQGGLGKMRARKPPPPPSIRGRASERGEKTHVQESMGAGGEGAAYPNSRS

SEQ ID NO: 794654 - protein, 148 aa, Homo sapiens
LYESARTLYEGLGTSTQQPSSLELGLPQLGWLVLGLGLELCLGASSLVMPGNPSLKQQLFSYAIPGLCPLGELWEVETAPSHGKEDEKGYHQTKEPHGLREGKAQNGVGEELLLQRRVPGITNDEAPKHSSNPSPRTSHPNCGQPQLQ

SEQ ID NO: 794655 - protein, 163 aa, Homo sapiens; identical to SEQ ID NO: 794629

SEQ ID NO: 794656 - protein, 131 aa, Homo sapiens; identical to SEQ ID NO: 794627

SEQ ID NO: 794657 - protein, 232 aa, Homo sapiens
MRASAAWQSHVPLPHLSLAAASKPAPFQGTSTQQPSSLELGLPQLGWLVLGLGLELCLGASSLVMPGNPSLKQQLFSYAIPGLCPLGGHGALLSDGSLSHPLCHVKEPSPPPIVLPRLVGPVCSFSYTSPGSLGNVVGSGFDREKTNKYCINKNTNKNNTTHTHKTCGAGRAREKLKHNWWGAGPQGNENLATRGPSRPRSTSGGSPKKKRGDTARNTPQGSATGYKGRPNP

SEQ ID NO: 794658 - protein, 131 aa, Homo sapiens; identical to SEQ ID NO: 794627

SEQ ID NO: 794659 - protein, 188 aa, Homo sapiens; identical to SEQ ID NO: 794635

SEQ ID NO: 794660 - protein, 188 aa, Homo sapiens; identical to SEQ ID NO: 794635

SEQ ID NO: 794661 - protein, 188 aa, Homo sapiens; identical to SEQ ID NO: 794635

SEQ ID NO: 794662 - protein, 194 aa, Homo sapiens; identical to SEQ ID NO: 794653

SEQ ID NO: 794663 - protein, 165 aa, Homo sapiens
MPELILYVAITLSVAERLVGPGHACAEPSFRSSRCSAPLCLLCSGSRVKSTSQLLSRPLSAVVLKRPEILTDESLSSLAVSCPLTSLVSSRSFQTSAISRDIDTAAKFIGAGAATVGVAGSGAGIGTVFGSLIIGYAREPFSEATALLLRHSWALPSRRPWGSFV

SEQ ID NO: 794664 - protein, 196 aa, Homo sapiens; identical to SEQ ID NO: 794648

SEQ ID NO: 794665 - protein, 194 aa, Homo sapiens; identical to SEQ ID NO: 794653

SEQ ID NO: 794666 - protein, 162 aa, Homo sapiens
MPELILYVAITLSVAERLVGPGHACAEPSFRSSRCSAPLCLLCSGSSSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYARV

SEQ ID NO: 794667 - protein, 46 aa, Homo sapiens
MQSLSSCEVLLTKEGVETNLEQANILQGAEELWQESCSHCREDREG

SEQ ID NO: 794668 - protein, 186 aa, Homo sapiens; identical to SEQ ID NO: 794652

SEQ ID NO: 794669 - protein, 103 aa, Homo sapiens
LWEFALLNSHVPTSAKLSGQPHFPLPAVTTNTATRGVCRTCRATLIGTSVTSLTLVTLLSLPGLLPHRPSRERFSIMVNFEPCILATGIPPSIRAPYCSLIIA

SEQ ID NO: 794670 - protein, 369 aa, Homo sapiens
GVWGRTSPSAAGFAPRSPAAYVGGPSVGLRVRVAMAVDITLLFRASVKTVKTRNKALGVAVGGGVDGSRDELFRRSPRPKGDFSSRAREVISHIGKLRDFLLEHRKDYINAYSHTMSEYGRMTDTERDQIDQDAQIFMRTCSEAIQQLRTEAHKEIHSQQVKEHRTAVLDFIEDYLKRVCKLYSEQRAIRVKRVVDKKRLSKLEPEPNTKTRESTSSEKVSQSPSKDSEENPATEERPEKILAETQPELGTWGDGKGEDELSPEEIQMFEQENQRLIGEMNSLFDEVRQIEGRVVEISRLQEIFTEKVLQQEAEIDSIHQLVVGATENIKEGNEDIREAIKNNAGFRVWILFFLVMCSFSLLFLDWYDS

SEQ ID NO: 794671 - protein, 340 aa, Homo sapiens
GVWGRTSPSAAGFAPRSPAAYVGGPSVGLRVRVAMAVDITLLFRASVKTVKTRNKALGVAVGGGVDGSRDELFRRSPRPKGDFSSRAREVISHIGKLRDFLLEHRKDYINAYSHTMSEYGRMTDTERDQIDQDAQIFMRTCSEAIQQLRTEAHKEIHSQQVKEHRTAVLDFIEDYLKRVCKLYSEQRAIRVKRVVDKKRLSKLEPEPNTKTRESTSSEKVSQSPSKDSEENPATEERPEKILAETQPELGTWGDGKGEDELSPEEIQMFEQENQRLIGEMNSLFDEVRQSRGGEFDPGISEGCTDGLELQLGGRIQEERSRLTGRGSGGGRGELGGNQEA

SEQ ID NO: 794672 - protein, 424 aa, Homo sapiens
GVWGRTSPSAAGFAPRSPAAYVGGPSVGLRVRVAMAVDITLLFRASVKTVKTRNKALGVAVGGGVDGSRDELFRRSPRPKGDFSSRAREVISHIGKLRDFLLEHRKDYINAYSHTMSEYGRMTDTERDQIDQDAQIFMRTCSEAIQQLRTEAHKEIHSQQVKEHRTAVLDFIEDYLKSISFSFKGQMEHFTIDVMQNLALLAEDCSISLYLMMALPEKLFEAVSLLVFSSATGVCKLYSEQRAIRVKRVVDKKRLSKLEPEPNTKTRESTSSEKVSQSPSKDSEENPATEERPEKILAETQPELGTWGDGKGEDELSPEEIQMFEQENQRLIGEMNSLFDEVRQIEGRVVEISRLQEIFTEKVLQQEAEIDSIHQLVVGATENIKEGNEDIREAIKNNAGFRVWILFFLVMCSFSLLFLDWYDS

SEQ ID NO: 794673 - protein, 526 aa, Homo sapiens
GGRLGPPHPWSLAASHPGLSPGLPPPRPASTMTVMSGENVDEASAAPGHPQDGSYPRQADHDDHECCERVVINISGLRFETQLKTLAQFPNTLLGNPKKRMRYFDPLRNEYFFDRNRPSFDAILYYYQSGGRLRRPVNVPLDMFSEEIKFYELGEEAMEKFREDEGFIKEEERPLPEKEYQRQVWLLFEYPESSGPARVIAIVSVMVILISIVIFCLETLPELKDDKDFTGTVHRIDNTTVIYNSNIFTDPFFIVETLCIIWFSFELVVRFFACPSKTDFFKNIMNFIDIVAIIPYFITLGTEIAEQEGNQKGEQATSLAILRVIRLVRVFRIFKLSRHSKGLQILGQTLKASMRELGLLIFFLFIGVILFSSAVYFAEAEEAESHFSSIPDAFWWAVVSMTTVGYGDMYPVTIGGKIVGSLCAIAGVLTIALPVPVIVSNFNYFYHRETEGEEQAQLLHVSSPNLASDSDLSRRSSSTMSKSEYMEIEEDMNNSIAHYRQVNIRTANCTTANQNCVNKSKLLTDV

SEQ ID NO: 794674 - protein, 4364 aa, Homo sapiens
MDSQNLAGEDKDSQPAADGPAASEDPSATESDLPNPHVGEVSVLSSGSPRLQETPQDCSGGPVRRCALCNCGEPALHGQRELRRFELPFDWPRCPVVSPGGSPGPNEAVLPSEDLSQIGFPEGLTPAHLGEPGGSCWAHHWCAAWSAGVWGQEGPQLCGVDKAIFSGISQRCSHCTRLGASIPCRSPGCPRLYHFPCATASGSFLSMKTLQLLCPEHSEGAAYLEEARCAVCEGPGELCDLFFCTSCGHHYHGACLDTALTARKRAGWQCPECKVCQACRKPGNDSKMLVCETCDKGYHTFCLKPPMEELPAHSWKCKACRVCRACGAGSAELNPNSEWFENYSLCHRCHKAQGGQTIRSVAEQHTPVCSRFSPPEPGDTPTDEPDALYVACQGQPKGGHVTSMQPKEPGPLQCEAKPLGKAGVQLEPQLEAPLNEEMPLLPPPEESPLSPPPEESPTSPPPEASRLSPPPEELPASPLPEALHLSRPLEESPLSPPPEESPLSPPPESSPFSPLEESPLSPPEESPPSPALETPLSPPPEASPLSPPFEESPLSPPPEELPTSPPPEASRLSPPPEESPMSPPPEESPMSPPPEASRLFPPFEESPLSPPPEESPLSPPPEASRLSPPPEDSPMSPPPEESPMSPPPEVSRLSPLPVVSRLSPPPEESPLSPPALSPLGELEYPFGAKGDSDPESPLAAPILETPISPPPEANCTDPEPVPPMILPPSPGSPVGPASPILMEPLPPQCSPLLQHSLVPQNSPPSQCSPPALPLSVPSPLSPIGKVVGVSDEAELHEMETEKVSEPECPALEPSATSPLPSPMGDLSCPAPSPAPALDDFSGLGEDTAPLDGIDAPGSQPEPGQTPGSLASELKGSPVLLDPEELAPVTPMEVYPECKQTAGRGSPCEEQEEPRAPVAPTPPTLIKSDIVNEISNLSQGDASASFPGSEPLLGSPDPEGGGSLSMELGVSTDVSPARDEGSLRLCTDSLPETDDSLLCDAGTAISGGKAEGEKGRRRSSPARSRIKQGRSSSFPGRRRPRGGAHGGRGRGRARLKSTASSIETLVVADIDSSPSKEEEEEDDDTMQNTVVLFSNTDKFVLMQDMCVVCGSFGRGAEGHLLACSQCSQCYHPYCVNSKITKVMLLKGWRCVECIVCEVCGQASDPSRLLLCDDCDISYHTYCLDPPLLTVPKGGWKCKWCVSCMQCGAASPGFHCEWQNSYTHCGPCASLVTCPICHAPYVEEDLLIQCRHCERWMHAGCESLFTEDDVDHAPDEGFDCVSCQPYVVKPVAPVAPPELVPMKVKEPEPQYFRFEGVWLTETGMALLRNLTMSPLHKRRQRRGRLGLPGEAGLEGSEPSDALGPDDKKDGDLDTDELLKGEGGVEHMECEIKLEGPVSPDVEPGKEETEESKKRKRKPYRPGIGGFMVRQRKSHTRTKKGPAAQAEVLSGDGQPDEVIPADLPAEGAVEQSLAEGDEKKKQQRRGRKRSKLEGMFPAYLQEAFFGKELLDLSRKALFAVGVGRPSFGLGTPKAKGDGGSERKELPTSQKGDDGPDIADEESRGLEGKADTPGPEDGGVKASPVPSDPEKPGTPGEGMLSSDLDRISTEELPKMESKDLQQLFKDVLGSEREQHLGCGTPGLEGSRTPLQRPFLQGGLPLGNLPSSSPMDSYPGLCQSPFLDSRERGGFFSPEPGEPDSPWTGSGGTTPSTPTTPTTEGEGDGLSYNQRSLQRWEKDEELGQLSTISPVLYANINFPNLKQDYPDWSSRCKQIMKLWRKVPAADKAPYLQKAKDNRAAHRINKVQKQAESQINKQTKVGDIARKTDRPALHLRIPPQPGALGSPPPAAAPTIFIGSPTTPAGLSTSADGFLKPPAGSVPGPDSPGELFLKLPPQVPAQAPSQDPFGLAPAYPLEPRFPTAPPTYPPYPSPTGAPAQPPMLGASSRPGAGQPGEFHTTPPGTPRHQPSTPDPFLKPRCPSLDNLAVPESPGVGGGKASEPLLSPPPFGESRKALEVKKEELGASSPSYGPPNLGFVDSPSSGTHLGGLELKTPDVFKAPLTPRASQVEPQSPGLGLRPQEPPPAQALAPSPPSHPDIFRPGSYTDPYAQPPLTPRPQPPPPESCCALPPRSLPSDPFSRVPVSPQSQSSSQSPLTPRPLSAEAFCPSPVTPRFQSPDPYSRPPSRPQSRDPFAPLHKPPRPQPPEVAFKAGSLAHTSLGAGGFPAALPAGPAGELHAKVPSGQPPNFVRSPGTGAFVGTPSPMRFTFPQAVGEPSLKPPVPQPGLPPPHGINSHFGPGPTLGKPQSTNYTVATGNFHPSGSPLGPSSGSTGESYGLSPLRPPSVLPPPAPDGSLPYLSHGASQRSGITSPVEKREDPGTGMGSSLATAELPGTQDPGMSGLSQTELEKQRQRQRLRELLIRQQIQRNTLRQEKETAAAAAGAVGPPGSWGAEPSSPAFEQLSRGQTPFAGTQDKSSLVGLPPSKLSGPILGPGSFPSDDRLSRPPPPATPSSMDVNSRQLVGGSQAFYQRAPYPGSLPLQQQQQQLWQQQQATAATSMRFAMSARFPSTPGPELGRQALGSPLAGISTRLPGPGEPVPGPAGPAQFIELRHNVQKGLGPGGTPFPGQGPPQRPRFYPVSEDPHRLAPEGLRGLAVSGLPPQKPSAPPAPELNNSLHPTPHTKGPTLPTGLELVNRPPSSTELGRPNPLALEAGKLPCEDPELDDDFDAHKALEDDEELAHLGLGVDVAKGDDELGTLENLETNDPHLDDLLNGDEFDLLAYTDPELDTGDKKDIFNEHLRLVESANEEAEREALLRGVEPGPLGPEERPPPAADASEPRLASVLPEVKPKVEEGGRHPSPCQFTIATPKVEPAPAANSLGLGLKPGQSMMGSRDTRMGTGPFSSSGHTAEKASFGATGGPPAHLLTPSPLSGPGGSSLLEKFELESGALTLPGGPAASGDELDKMESSLVASELPLLIEDLLEHEKKELQKKQQLSAQLQPAQQQQQQQQQHSLLPAPGPAQAMSLPHEGSSPSLAGSQQQLSLGLAVARQPGLPQPLMPTQPPAHALQQRLAPSMAMVSNQGHMLSGQHGGQAGLVPQQSSQPVLSQKPMGTMPPSMCMKPQQLAMQQQLANSFFPDTDLDKFAAEDIIGPIAKAKMVALKGIKKVMAQGSIGVAPGMNRQQVSLLAQRLSGGPSSDLQNHVAAGSGQERSAGDPSQPRPNPPTFAQGVINEADQRQYEEWLFHTQQLLQMQLKVLEEQIGVHRKSRKALCAKQRTAKKAGREFPEADAEKLKLVTEQQSKIQKQLDQVRKQQKEHTNLMAEYRNKQQQQQQQQQQQQQQHSAVLALSPSQSPRLLTKLPGQLLPGHGLQPPQGPPGGQAGGLRLTPGGMALPGQPGGPFLNTALAQQQQQQHSGGAGSLAGPSGGFFPGNLALRSLGPDSRLLQERQLQLQQQRMQLAQKLQQQQQQQQQQQHLLGQVAIQQQQQQGPGVQTNQALGPKPQGLMPPSSHQGLLVQQLSPQPPQGPQGMLGPAQVAVLQQQHPGALGPQGPHRQVLMTQSRVLSSPQLAQQGQGLMGHRLVTAQQQQQQQQHQQQGSMAGLSHLQQSLMSHSGQPKLSAQPMGSLQQLQQQQQLQQQQQLQQQQQQQLQQQQQLQQQQLQQQQQQQQLQQQQQQQLQQQQQQLQQQQQQQQQQFQQQQQQQQMGLLNQSRTLLSPQQQQQQQVALGPGMPAKPLQHFSSPGALGPTLLLTGKEQNTVDPAVSSEATEGPSTHQGGPLAIGTTPESMATEPGEVKPSLSGDSQLLLVQPQPQPQPSSLQLQPPLRLPGQQQQQVSLLHTAGGGSHGQLGSGSSSEASSVPHLLAQPSVSLGDQPGSMTQNLLGPQQPMLERPMQNNTGPQPPKPGPVLQSGQGLPGVGIMPTVGQLRAQLQGVLAKNPQLRHLSPQQQQQLQALLMQRQLQQSQAVRQTPPYQEPGTQTSPLQGLLGCQPQLGGFPGPQTGPLQELGAGPRPQGPPRLPAPPGALSTGPVLGPVHPTPPPSSPQEPKRPSQLPSPSSQLPTEAQLPPTHPGTPKPQGPTLEPPPGRVSPAAAQLADTLFSKGLGPWDPPDNLAETQKPEQSSLVPGHLDQVNGQVVPEASQLSIKQEPREEPCALGAQSVKREANGEPIGAPGTSNHLLLAGPRSEAGHLLLQKLLRAKNVQLSTGQGSEGLRAEINGHIDSKLAGLEQKLQGTPSNKEDAAARKPLTPKPKRVQKASDRLVSSRKKLRKEDGVRASEALLKQLKQELSLLPLTEPAITANFSLFAPFGSGCPVNGQSQLRGAFGSGALPTGPDYYSQLLTKNNLSNPPTPPSSLPPTPPPSVQQKMV

SEQ ID NO: 794675 - protein, 4332 aa, Homo sapiens
MDSQNLAGEDKDSQPAADGPAASEDPSATESDLPNPHVGEVSVLSSGSPRLQETPQDCSGGPVRRCALCNCGEPALHGQRELRRFELPFDWPRCPVVSPGGSPGPNEAVLPSEDLSQIGFPEGLTPAHLGEPGGSCWAHHWCAAWSAGVWGQEGPQLCGVDKAIFSGISQRCSHCTRLGASIPCRSPGCPRLYHFPCATASGSFLSMKTLQLLCPEHSEGAAYLEEARCAVCEGPGELCDLFFCTSCGHHYHGACLDTALTARKRAGWQCPECKVCQACRKPGNDSKMLVCETCDKGYHTFCLKPPMEELPAHSWKCKACRVCRACGAGSAELNPNSEWFENYSLCHRCHKAQGGQTIRSVAEQHTPVCSRFSPPEPGDTPTDEPDALYVACQGQPKGGHVTSMQPKEPGPLQCEAKPLGKAGVQLEPQLEAPLNEEMPLLPPPEESPLSPPPEESPTSPPPEASRLSPPPEELPASPLPEALHLSRPLEESPLSPPPEESPLSPPPESSPFSPLEESPLSPPEESPPSPALETPLSPPPEASPLSPPFEESPLSPPPEELPTSPPPEASRLSPPPEESPMSPPPEESPMSPPPEASRLFPPFEESPLSPPPEESPLSPPPEASRLSPPPEDSPMSPPPEESPMSPPPEVSRLSPLPVVSRLSPPPEESPLSPPPEESPTSPPPEASRLSPPPEDSPTSPPPEDSPASPPPEDSLMSLPLEESPLLPLPEEPQLCPRSEGPHLSPRPEEPHLSPRPEEPHLSPQAEEPHLSPQPEEPCLCAVPEEPHLSPQAEGPHLSPQPEELHLSPQTEEPHLSPVPEEPCLSPQPEESHLSPQSEEPCLSPRPEESHLSPELEKPPLSPRPEKPPEEPGQCPAPEELPLFPPPGEPSLSPLLGEPALSEPGEPPLSPLPEELPLSPSGEPSLSPQLMPPDPLPPPLSPIITAAAPPALSPLGELEYPFGAKGDSDPESPLAAPILETPISPPPEANCTDPEPVPPMILPPSPGSPVGPASPILMEPLPPQCSPLLQHSLVPQNSPPSQCSPPALPLSVPSPLSPIGKVVGVSDEAELHEMETEKVSEPECPALEPSATSPLPSPMGDLSCPAPSPAPALDDFSGLGEDTAPLDGIDAPGSQPEPGQTPGSLASELKGSPVLLDPEELAPVTPMEVYPECKQTAGRGSPCEEQEEPRAPVAPTPPTLIKSDIVNEISNLSQGDASASFPGSEPLLGSPDPEGGGSLSMELGVSTDVSPARDEGSLRLCTDSLPETDDSLLCDAGTAISGGKAEGEKGRRRSSPARSRIKQGRSSSFPGRRRPRGGAHGGRGRGRARLKSTASSIETLVVADIDSSPSKEEEEEDDDTMQNTVVLFSNTDKFVLMQDMCVVCGSFGRGAEGHLLACSQCSQCYHPYCVNSKITKVMLLKGWRCVECIVCEVCGQASDPSRLLLCDDCDISYHTYCLDPPLLTVPKGGWKCKWCVSCMQCGAASPGFHCEWQNSYTHCGPCASLVTCPICHAPYVEEDLLIQCRHCERWMHAGCESLFTEDDVDHAPDEGFDCVSCQPYVVKPVAPVAPPELVPMKVKEPEPQYFRFEGVWLTETGMALLRNLTMSPLHKRRQRRGRLGLPGEAGLEGSEPSDALGPDDKKDGDLDTDELLKGEGGVEHMECEIKLEGPVSPDVEPGKEETEESKKRKRKPYRPGIGGFMVRQRKSHTRTKKGPAAQAEVLSGDGQPDEVIPADLPAEGAVEQSLAEGDEKKKQQRRGRKRSKLEGMFPAYLQEAFFGKELLDLSRKALFAVGVGRPSFGLGTPKAKGDGGSERKELPTSQKGDDGPDIADEESRGLEGKADTPGPEDGGVKASPVPSDPEKPGTPGEGMLSSDLDRISTEELPKMESKDLQQLFKDVLGSEREQHLGCGTPGLEGSRTPLQRPFLQGGLPLGNLPSSSPMDSYPGLCQSPFLDSRERGGFFSPEPGEPDSPWTGSGGTTPSTPTTPTTEGEGDGLSYNQRSLQRWEKDEELGQLSTISPVLYANINFPNLKQDYPDWSSRCKQIMKLWRKVPAADKAPYLQKAKDNRAAHRINKVQKQAESQINKQTKVGDIARKTDRPALHLRIPPQPGALGSPPPAAAPTIFIGSPTTPAGLSTSADGFLKPPAGSVPGPDSPGELFLKLPPQVPAQAPSQDPFGLAPAYPLEPRFPTAPPTYPPYPSPTGAPAQPPMLGASSRPGAGQPGEFHTTPPGTPRHQPSTPDPFLKPRCPSLDNLAVPESPGVGGGKASEPLLSPPPFGESRKALEVKKEELGASSPSYGPPNLGFVDSPSSGTHLGGLELKTPDVFKAPLTPRASQVEPQSPGLGLRPQEPPPAQALAPSPPSHPDIFRPGSYTDPYAQPPLTPRPQPPPPESCCALPPRSLPSDPFSRVPVSPQSQSSSQSPLTPRPLSAEAFCPSPVTPRFQSPDPYSRPPSRPQSRDPFAPLHKPPRPQPPEVAFKAGSLAHTSLGAGGFPAALPAGPAGELHAKVPSGQPPNFVRSPGTGAFVGTPSPMRFTFPQAVGEPSLKPPVPQPGLPPPHGINSHFGPGPTLGKPQSTNYTVATGNFHPSGSPLGPSSGSTGESYGLSPLRPPSVLPPPAPDGSLPYLSHGASQRSGITSPVEKREDPGTGMGSSLATAELPGTQDPGMSGLSQTELEKQRQRQRLRELLIRQQIQRNTLRQEKETAAAAAGAVGPPGSWGAEPSSPAFEQLSRGQTPFAGTQDKSSLVGLPPSKLSGPILGPGSFPSDDRLSRPPPPATPSSMDVNSRQLVGGSQAFYQRAPYPGSLPLQQQQQQLWQQQQATAATSMRFAMSARFPSTPGPELGRQALGSPLAGISTRLPGPGEPVPGPAGPAQFIELRHNVQKGLGPGGTPFPGQGPPQRPRFYPVSEDPHRLAPEGLRGLAVSGLPPQKPSAPPAPELNNSLHPTPHTKGPTLPTGLELVNRPPSSTELGRPNPLALEAGKLPCEDPELDDDFDAHKALEDDEELAHLGLGVDVAKGDDELGTLENLETNDPHLDDLLNGDEFDLLAYTDPELDTGDKKDIFNEHLRLVESANEEAEREALLRGVEPGPLGPEERPPPAADASEPRLASVLPEVKPKVEEGGRHPSPCQFTIATPKVEPAPAANSLGLGLKPGQSMMGSRDTRMGTGPFSSSGHTAEKASFGATGGPPAHLLTPSPLSGPGGSSLLEKFELESGALTLPGGPAASGDELDKMESSLVASELPLLIEDLLEHEKKELQKKQQLSAQLQPAQQQQQQQQQHSLLPAPGPAQAMSLPHEGSSPSLAGSQQQLSLGLAVARQPGLPQPLMPTQPPAHALQQRLAPSMAMVSNQGHMLSGQHGGQAGLVPQQSSQPVLSQKPMGTMPPSMCMKPQQLAMQQQLANSFFPDTDLDKFAAEDIIGPIAKAKMVALKGIKKVMAQGSIGVAPGMNRQQVSLLAQRLSGGPSSDLQNHVAAGSGQERSAGDPSQPRPNPPTFAQGVINEADQRQYEEWLFHTQQLLQMQLKVLEEQIGVHRKSRKALCAKQRTAKKAGREFPEADAEKLKLVTEQQSKIQKQLDQVRKQQKEHTNLMAEYRNKQQQQQQQQQQQQQQHSAVLALSPSQSPRLLTKLPGQLLPGHGLQPPQGPPGGQAGGLRLTPGGMALPGQPGGPFLNTALAQQQQQQHSGGAGSLAGPSGGFFPGNLALRSLGPDSRLLQERQLQLQQQRMQLAQKLQQQQQQQQQQQHLLGQVAIQQQQQQGPGVQTNQALGPKPQGLMPPSSHQGLLVQQLSPQPPQGPQGMLGPAQVAVLQQQHPGALGPQGPHRQVLMTQSRVLSSPQLAQQGQGLMGHRLVTAQQQQQQQQHQQQGSMAGLSHLQQSLMSHSGQPKLSAQPMGSLQQLQQQQQLQQQQQLQQQQQQQLQQQQQLQQQQLQQQQQQQQLQQQQQQQLQQQQQQLQQQQQQQQQQFQQQQQQQQMGLLNQSRTLLSPQQQQQQQVALGPGMPAKPLQHFSSPGALGPTLLLTGKEQNTVDPAVSSEATEGPSTHQGGPLAIGTTPESMATEPGEVKPSLSGDSQLLLVQPQPQPQPSSLQLQPPLRLPGQQQQQVSLLHTAGGGSHGQLGSGSSSEASSVPHLLAQPSVSLGDQPGSMTQNLLGPQQPMLERPMQNNTGPQPPKPGPVLQSGQGLPGVGIMPTVGQLRAQLQGVLAKNPQLRHLSPQQQQQLQALLMQRQLQQSQAVRQTPPYQEPGTQTSPLQGLLGCQPQLGGFPGPQTGPLQELGAGPRPQGPPRLPAPPGALSTGPVLGPVHPTPPPSSPQEPKRPSQLPSPSSQLSH

SEQ ID NO: 794676 - protein, 1627 aa, Homo sapiens
RGGSELGASTPNAVTVPRPQRANRGSTVGGATPPSGPRPHPAPPPPPSRRRGQAARAVQSEVLVHEDRFVLMASELGARDDGGCTELAKPLYLQYLERALRLDHFLRQTSAIFNRNISSDDSEDGLDDSNPLLPQSGDPLIQVKEEPPNSLLGETSGAGSSGMLNTYSLNGVLQSESKCDKGNLYNFSKLKKSRKWLKSILLSDESSEADSQSEDDDEEELNLSREELHNMLRLHKYKKLHQNKYSKDKELQQYQYYSAGLLSTYDPFYEQQRHLLGPKKKKFKEEKKLKAKLKKVKKKRRRDEELSSEESPRRHHHQTKVFAKFSHDAPPPGTKKKHLSIEQLNARRRKVWLSIVKKELPKANKQKASARNLFLTNSRKLAHQCMKEVRRAALQAQKNCKETLPRARRLTKEMLLYWKKYEKVEKEHRKRAEKEALEQRKLDEEMREAKRQQRKLNFLITQTELYAHFMSRKRDMGHDGIQEEILRKLEDSSTQRQIDIGGGVVVNITQEDYDSNHFKAQALKNAENAYHIHQARTRSFDEDAKESRAAALRAANKSGTGFGESYSLANPSIRAGEDIPQPTIFNGKLKGYQLKGMNWLANLYEQGINGILADEMGLGKTVQSIALLAHLAERENIWGPFLIISPASTLNNWHQEFTRFVPKFKVLPYWGNPHDRKVIRRFWSQKTLYTQDAPFHVVITSYQLVVQDVKYFQRVKWQYMVLDEAQALKSSSSVRWKILLQFQCRNRLLLTGTPIQNTMAELWALLHFIMPTLFDSHEEFNEWFSKDIESHAENKSAIDENQLSRLHMILKPFMLRRIKKDVENELSDKIEILMYCQLTSRQKLLYQALKNKISIEDLLQSSMGSTQQAQNTTSSLMNLVMQFRKVCNHPELFERQETWSPFHISLKPYHISKFIYRHGQIRVFNHSRDRWLRVLSPFAPDYIQRSLFHRKGINEESCFSFLRFIDISPAEMANLMLQGLLARWLALFLSLKASYRLHQLRSWGAPEGESHQRYLRNKDFLLGVNFPLSFPNLCSCPLLKSLVFSSHCKAVSGYSDQVVHQRRSATSSLRRCLLTELPSFLCVASPRVTAVPLDSYCNDRSAEYERRVLKEGGSLAAKQCLLNGAPELAADWLNRRSQFFPEPAGGLWSIRPQNGWSFIRIPGKESLITDSGKLYALDVLLTRLKSQGHRVLIYSQMTRMIDLLEEYMVYRKHTYMRLDGSSKISERRDMVADFQNRNDIFVFLLSTRAGGLGINLTAADTVIFYDSDWNPTVDQQAMDRAHRLGQTKQVTVYRLICKGTIEERILQRAKEKSEIQRMVISGGNFKPDTLKPKEVVSLLLDDEELEKKLRLRQEEKRQQEETNRVKERKRKREKYAEKKKKEDELDGKRRKEGVNLVIPFVPSADNSNLSADGDDSFISVDSAMPSPFSEISISSELHTGSIPLDESSSDMLVIVDDPASSAPQSRATNSPASITGSVSDTVNGISIQEMPAAGRGHSARSRGRPKGSGSTAKGAGKGRSRKSTAGSAAAMAGAKAGAAAASAAAYAAYGYNVSKGISASSPLQTSLVRPAGLADFGPSSASSPLSSPLSKGNNVPGNPKNLHMTSSLAPDSLVRKQGKGTNPSGGR

SEQ ID NO: 794677 - protein, 81 aa, Homo sapiens
VSIQQYFFLRKGITCHRKRKCCGFRHSHPSCLQALVTDSVLGPLLVNSGFSMLGIRFQKSGPQDALPSGSALSALPQAQQK

SEQ ID NO: 794678 - protein, 1490 aa, Homo sapiens
ATARDPGAAAGLSLHPTYFNLAEAARIWATATCGERGPGEGRPQPELYCKLVGGPTAPGSGHTIQGQFCDYCNSEDPRKAHPVTNAIDGSERWWQSPPLSSGTQYNRVNLTLDLGQLFHVAYILIKFANSPRPELWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQENCLLYQHLPVTRFPCTLACEARHFLLDGEPRPVAVRQPTPAHPVMVDLSGREVELHLRLRIPQVGHYVVVVEYSTEAAQLFVVDVNVKSSGSVLAGQVNIYSCNYSVLCRSAVIDHMSRIAMYELLADADIQLKGHMARFLLHQVCIIPIEEFSAEYVRPQVHCIASYGRFVNQSATCVSLAHETPPTALILDVLSGRPFPHLPQQSSPSVDVLPGVTLKAPQNQVTLRGRVPHLGRYVFVIHFYQAAHPTFPAQVSVDGGWPRAGSFHASFCPHVLGCRDQVIAEGQIEFDISEPEVAATVKVPEGKSLVLVRVLVVPAENYDYQILHKKSMDKSLEFITNCGKNSFYLDPQTASRFCKNSARSLVAFYHKGALPCECHPTGATGPHCSPEGGQCPCQPNVIGRQCTRCATGHYGFPRCKRKSCSCGRRLCEEMTGQCRCPPRTVRPQCEVCETHSFSFHPMAGCEGCNCSRRGTIEAAMPECDRDSGQCRCKPRITGRQCDRCASGFYRFPECVPCNCNRDGTEPGVCDPGTGACLCKENVEGTECNVCREGSFHLDPANLKGCTSCFCFGVNNQCHSSHKRRTKFVDMLGWHLETADRVDIPVSFNPGSNSMVADLQELPATIHSASWVAP

SEQ ID NO: 794679 - protein, 358 aa, Homo sapiens
PRGSRRHTEQSQAHLDLGQLFHVAYILIKFANSPRPELWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIRKFHFKLVYLSLCVLPQRSHQANFGSVNNFLHALSLQSISCARYVTSVTYTVSLNFGFIACKWK

SEQ ID NO: 794680 - protein, 769 aa, Homo sapiens
PRGSRRHTEQSQAHLDLGQLFHVAYILIKFANSPRPELWVLERSVDFGSTYSPWQYFAHSKVDCLKEFGREANMAVTRDDDVLCVTEYSRIVPLENGEVVVSLINGRPGAKNFTFSHTLREFTKATNIRLRFLRTNTLLGHLISKAQRDPTVTRRYYYSIKDISIGGQCVCNGHAEVCNINNPEKLFRCECQHHTCGETCDRCCTGYNQRRWRPAAWEQSHECEACNCHGHASNCYYDPDVERQQASLNTQGIYAGGGVCINCQHNTAGVNCEQCAKGYYRPYGVPVDAPDGCIPCSCDPEHADGCEQGSGRCHCKPNFHGDNCEKCAIGYYNFPFCLRIPIFPVSTPSSEDPVAGDIKGCDCNLEGVLPEICDAHGRCLCRPGVEGPRCDTCRSGFYSFPICQACWCSALGSYQMPCSSVTGQCECRPGVTGQRCDRCLSGAYDFPHCQGSSSACDPAGTINSNLGYCQCKLHVEGPTCSRCKLLYWNLDKENPSGCSECKCHKAGTVSGTGECRQGDGDCHCKSHVGGDSCDTCEDGYFALEKSNYFGCQGCQCDIGGALSSMCSGPSGVCQCREHVVGKVCQRPENNYYFPDLHHMKYEIEDGSTPNGRDLRFGFDPLAFPEFSWRGYAQMTSVQNDVRITLNVGKSSGSLFRVILRYVNPGTEAVSGHITIYPSWGAAQSKEIIFLPSKEPAFVTVPGNGFADPFSITPGIWVACIKAEGVLLDYLVLLPRDYYEASVLQLPVTEPCAYAGPPQEKSVWGRRCSR

SEQ ID NO: 794681 - protein, 77 aa, Homo sapiens
VMGLFLSLFAMLSPTSGTESGTKLFYCRASVNLEIFLSWENQDFQRGKAKHQPGPPSSNPKIHPECTRMGLEVNFKL

SEQ ID NO: 794682 - protein, 71 aa, Homo sapiens
NLRKAHPLVLREALTNTLQERGHVRENSASFIACNRQTVFHISQWDIGIFSLKEGIIHKEKTSMLHCILKG

SEQ ID NO: 794683 - protein, 125 aa, Homo sapiens
TEYAVSPMMIQPQILFFTEHLTLSSVSFLCIGHWETTCSHLNRDLAFRRHHSLPLCPGEHQLALFQKQKENEPQPLKSLRTEEKLLTFLICVQSGWPWVQTQLVSPFVSWTDLIPGCLNDVSPHQ

SEQ ID NO: 794684 - protein, 337 aa, Homo sapiens
MADGSFSLAGHLLRSPGGSTSRLHSIEAILGFTKDDGILGTFPAERGARGAKERDRRLGARPACPKAPEEGSEPSPPPAPAPAPEYEAPRPYCPKEPGEARPSPGLPVGPATGEAKLSEEEQPKKKHRRNRTTFTTYQLHELERAFEKSHYPDVYSREELAGKVNLPEVRVQVWFQNRRAKWRRQEKLEVSSMKLQDSPLLSFSRSPPSATLSPLGAGPGSGGGPAGGALPLESWLGPPLPGGGATALQSLPGFGPPAQSLPASYTPPPPPPPFLNSPPLGPGLQPLAPPPPSYPCGPGFGDKFPLDEADPRNSSIAALRLKAKEHIQAIGKPWQAL

SEQ ID NO: 794685 - protein, 437 aa, Homo sapiens
MADGSFSLAGHLLRSPGGSTSRLHSIEAILGFTKDDGILGTFPAERGARGAKERDRRLGARPACPKAPEEGSEPSPPPAPAPAPEYEGECAPWLCEAVRAPELRSWPDESAPSLTFIKATGRGVGDRLWRELPICIRESLGPIAALTTDLPGPSRSPQAGWPVPTARRGRPKGVLGSASDLPGLVAPAPRPYCPKEPGEARPSPGLPVGPATGEAKLSEEEQPKKKHRRNRTTFTTYQLHELERAFEKSHYPDVYSREELAGKVNLPEVRVQVWFQNRRAKWRRQEKLEVSSMKLQDSPLLSFSRSPPSATLSPLGAGPGSGGGPAGGALPLESWLGPPLPGGGATALQSLPGFGPPAQSLPASYTPPPPPPPFLNSPPLGPGLQPLAPPPPSYPCGPGFGDKFPLDEADPRNSSIAALRLKAKEHIQAIGKPWQAL

SEQ ID NO: 794686 - protein, 92 aa, Homo sapiens
AHLDGHVRGWGEASPTLGRRDSRATLGLPMILICPRLRSFPGYGTFTAKTRIVPCKAAWLITLLAAMRLPPSSRMIDPKERVTQSTSSPISM

SEQ ID NO: 794687 - protein, 804 aa, Homo sapiens
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 794688 - protein, 776 aa, Homo sapiens
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEAGVPARALFPPSAIVREGYLLKRKEEPAGLATRFAFKKRYVWLSGETLSFSKSPEWQVVTQDGTGALHTTYLQCKNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 794689 - protein, 746 aa, Homo sapiens
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKNVNELNQWLSALRKASAPNPNKLAACHPGAFRSARWTCCLQAERSGEGAGRLQAPPSPPVNQRVSHFRLGWLCNLGQVTQPLYASVSSTVK

SEQ ID NO: 794690 - protein, 226 aa, Homo sapiens
MDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEGEFLWSGH

SEQ ID NO: 794691 - protein, 830 aa, Homo sapiens
MAKSSSLNVRVVEGRALPAKDVSGSSDPYCLVKVDDEVVARTATVWRSLGPFWGEEYTVHLPLDFHQLAFYVLDEDTVGHDDIIGKISLSREAITADPRGIDSWINLSRVDPDAEVQGEICLSVQMLEDGQGRCLRCHVLQARDLAPRDISGTSDPFARVFWGSQSLETSTIKKTRFPHWDEVLELREMPGAPSPLRVELWDWDMVGKNDFLGMVEFSPKTLQQKPPKGWFRLLPFPRAEEDSGGNLGALRVKVRLIEDRVLPSQCYQPLMELLMESVQGPAEEDTASPLALLEELTLGDCRQDLATKLVKLFLGRGLAGRFLDYLTRREVARTMDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKVRPHRDGEQGASSVPTRPLIASHPLQNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 794692 - protein, 496 aa, Homo sapiens
MDPNTLFRSNSLASKSMEQFMKLVGMPYLHEVLKPVISRVFEEKKYMELDPCKMDLGRTRRISFKGALSEEQMRETSLGLLTGYLGPIVDAIVGSVGRCPPAMRLAFKQLHRRVEERFPQAEHQDVKYLAISGFLFLRFFAPAILTPKLFDLRDQHADPQTSRSLLLLAKAVQSIGNLGQQLGQGKELWMAPLHPFLLQCVSRVRDFLDRLVDVDGDEAGVPARALFPPSAIVREGYLLKRKEEPAGLATRFAFKKRYVWLSGETLSFSKSPEWQMCHSIPVSHIRAVERVDEGAFQLPHVMQVVTQDGTGALHTTYLQCKVRPHRDGEQGRPSVPTRPLIASHPLQNVNELNQWLSALRKASAPNPNKLAACHPGAFRSARWTCCLQAERSAAGCSRTHSAVTLGDWSDPLDPDAEAQTVYRQLLLGRDQLRLKLLEDSNMDTTLEADTGACPEVLARQRAATARLLEVLADLDRAHEEFQQQERGKAALGPLGP

SEQ ID NO: 794693 - protein, 485 aa, Homo sapiens
EIGEDKTGHWGDHNFMLRGISQLPAVATMSWVLLPVLWLIVQTQAIAIKQTPELTLHEIVCPKKLHILHKREIKNNQTEKHGKEERYEPEVQYQMILNGEEIILSLQKTKHLLGPDYTETLYSPRGEEITTKPENMEHCYYKGNILNEKNSVASISTCDGLRGYFTHHHQRYQIKPLKSTDEKEHAVFTSNQEEQDPANHTCGVKSTDGKQGPIRISRSLKSPEKEDFLRAQKYIDLYLVLDNAFYKNYNENLTLIRSFVFDVMNLLNVIYNTIDVQVALVGMEIWSDGDKIKVVPSASTTFDNFLRWHSSNLGKKIHDHAQLLSGISFNNRRVGLAASNSLCSPSSVAVIEAKKKNNVALVGVMSHELGHVLGMPDVPFNTKCPSGSCVMNQYLSSKFPKDFSTSCRAHFERYLLSQKPKCLLQAPIPTNIMTTPVCGNHLLEVGEDCDCGSPKECTNLCCEALTCKLKPGTDCGGDAPNHTTE

SEQ ID NO: 794694 - protein, 485 aa, Homo sapiens; identical to SEQ ID NO: 794693

SEQ ID NO: 794695 - protein, 37 aa, Homo sapiens
MPAAAGEAQLGLHNPQGQREPCPYRVGGAGAHTPGHS

SEQ ID NO: 794696 - protein, 111 aa, Homo sapiens
RECYVAPIRLVYIKGVVILPSNWWFPRTLCVSPEGYVTLPQVLSQRVLSLSHQTEESSKLRNHFRLGAVAHACNPSTLGGRGGRITRSGVRDHSGQHGELSPQPRRWDQHN

SEQ ID NO: 794697 - protein, 120 aa, Homo sapiens
MRPKTLRNSAARSRKEPGFLNHHMEGSCLQLGELSSVGYWWPFGHPGPAQGHLPVAVWASWVVAGISIALYLPPHPEGRHALWNREPFGRCKRIPGNGSKALEEFKYVLGQDKSLSSSRL

SEQ ID NO: 794698 - protein, 106 aa, Homo sapiens
MRPKTLRNSAARSRKEPGFLNHHMEGSCLQLGELSSVGYWWPFGHPGPAQGHLPVAVWASWVVAGISIALYLPPHPEGRYEGPFKRHTKTFRSAQCADCLTCALEP

SEQ ID NO: 794699 - protein, 102 aa, Homo sapiens
RGAGAAEMQAMQPRSSESWDDSCPCWKGPCQSWQGSTALGQEMLVESWKTMWGTGSGHRMVIVLLQDLDMDGEKQRRTFQVCPTGHAHHTLPALFRRPVRNT

SEQ ID NO: 794700 - protein, 74 aa, Homo sapiens
NIGVLVNRIHRASFTTALCNLLCDDAHQSFHKHYLSTQVGEHRPRNHRLKFATPAVPVGLHSLNRGEVSERVWM

SEQ ID NO: 794701 - protein, 110 aa, Homo sapiens
MSRIGLQPEKGDGVVSRLLFKRAYLNWVGLVLSMLITQNDFPKEFDTSDPNSVPFDFTNSIFHLVASLASSSSLFHIGESSRKCLSGYFLFSFSFYSQSFLTHFFPSNTL

SEQ ID NO: 794702 - protein, 256 aa, Homo sapiens
RTWAGGLEKPALERNGSSCLGAKGRGTPTWTPKSRTRGWARGCEGIFSGSSNGGEKCFSKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYDVLHRHALYLIIRMVCYDDGLGAGKSLLALKTTDASNEEYSLWVYQCNSLEQAQAICKVLSTAFDSVLTSEKP

SEQ ID NO: 794703 - protein, 240 aa, Homo sapiens
RTWAGGLEKPALERNGSSCLGAKGRGTPTWTPKSRTRGWARGCEGIFSGSSNGGEKCFSKGKKRHSSSSSQSSEISTKSKSVDSSLGGLSRSSTVASLDTDSTKSSGQSNNNSDTCAEFRIKYVGAIEKLKLSEGKGLEGPLDLINYIDVAQQDGKLPFVPPEEEFIMGVSKYGIKVSTSDQYDVLHRHALYLIIRMVCYDDGLGAGKSLLALKTTDASNEEYSLWVYQCNSLVRLRYFG

SEQ ID NO: 794704 - protein, 116 aa, Homo sapiens
ITIWCNVSGYQGPSEQNFQWSIYLPSSPEREVQIVSTMDSSFPYAIYTQRVRGGKIFIERVQGNPTLLHITDLQARDAGEYECHTPSTEKQYFGSYSAKMNLVGKEKLSSRCQRLA

SEQ ID NO: 794705 - protein, 166 aa, Homo sapiens
GLTLSLWLECSGIISAHCNLCLPSSSDPSTSASQVAGTTGVCHHAWVIFCIFCRPGFLPCCPGWLELLASSSLPTLTSQSSGITGVRHHARLYITIINTYACNTRAPRYIRKTLIDLKGELDCNTIIVGDFNTPLSVIDTSSRQKVNRETMELNYMLDLISLTDIY

SEQ ID NO: 794706 - protein, 177 aa, Homo sapiens
LLALLGGCGGGGGGGGGGAAALPACCKHDGRPRGAGRAAGAAEGKVVCIILELAQVLPPDTLPNRTVTLILSNNKISELQNGSFSGLTLLERLDLRNNLISRIDPGAFWGLSSLKRLDLTNNRIGCLNANIFRGLTNLARLNLSGNLFSSLPQGTFDYLSSLRSLEFQTEYLLCDCN

SEQ ID NO: 794707 - protein, 80 aa, Homo sapiens
QVALLVEPTGEHGPTVGVRRDNGGTLPSCVCTSHCARMIMVLAYKVTYFSCNLVPKLKKMPLSGNQLGKTLAEPHTFKYL

SEQ ID NO: 794708 - protein, 120 aa, Homo sapiens [sequence omitted]

SEQ ID NO: 794709 - protein, 102 aa, Homo sapiens
MGQVPSPPPTPHHQNTPWLPSWFPGQSEIQTKGEEATSGRFPSPCFPSPPAPGSPHVATSSLARLASDATIPGRGLWRKEGWLRAQLGSGLCPTMRGQFPFV

SEQ ID NO: 794710 - protein, 115 aa, Homo sapiens
RSKTHQRKVMWVYTWEQHYLAILGPEALIMASPMHNFDVGISFPIPFRILPCQVLSLMKYSLGQAQWLMPVIPALWEAKVGGSPEVRSSRPAWPTWQNPVSTEKKIQKLAGHGGS

SEQ ID NO: 794711 - protein, 254 aa, Homo sapiens
MATAGNPWGWFLGYLILGVAGSLVSGSCSQIINGEDCSPHSQPWQAALVMENELFCSGVLVHPQWVLSAAHCFQNSYTIGLGLHSLEADQEPGSQMVEASLSVRHPEYNRPLLANDLMLIKLDESVSESDTIRSISIASQCPTAGNSCLVSGWGLLANGRMPTVLQCVNVSVVSEEVCSKLYDPLYHPSMFCAGGGHDQKDSCNGDSGGPLICNGYLQGLVSFGKAPCGQVGVPGVYTNLCKFTEWIEKTVQAS

SEQ ID NO: 794712 - protein, 1040 aa, Homo sapiens
MGEEGGSASHDEEERASVLLGHSPGCEMCSQEAFQAQRSQLVELLVSGSLEGFESVLDWLLSWEVLSWEDYEGFHLLGQPLSHLARRLLDTVWNKGTWACQKLIAAAQEAQADSQSPKLHGCWDPHSLHPARDLQSHRPAIVRRLHSHVENMLDLAWERGFVSQYECDEIRLPIFTPSQRARRLLDLATVKANGLAAFLLQHVQELPVPLALPLEAATCKKYMAKLRTTVSAQSRFLSTYDGAETLCLEDIYTENVLEVWADVGMAGPPQKSPATLGLEELFSTPGHLNDDADTVLVVGEAGSGKSTLLQRLHLLWAAGQDFQEFLFVFPFSCRQLQCMAKPLSVRTLLFEHCCWPDVGQEDIFQLLLDHPDRVLLTFDGFDEFKFRFTDRERHCSPTDPTSVQTLLFNLLQGNLLKNARKVVTSRPAAVSAFLRKYIRTEFNLKGFSEQGIELYLRKRHHEPGVADRLIRLLQETSALHGLCHLPVFSWMVSKCHQELLLQEGGSPKTTTDMYLLILQHFLLHATPPDSASQGLGPSLLRGRLPTLLHLGRLALWGLGMCCYVFSAQQLQAAQVSPDDISLGFLVRAKGVVPGSTAPLEFLHITFQCFFAAFYLALSADVPPALLRHLFNCGRPGNSPMARLLPTMCIQASEGKDSSVAALLQKAEPHNLQITAAFLAGLLSREHWGLLAECQTSEKALLRRQACARWCLARSLRKHFHSIPPAAPGEAKSVHAMPGFIWLIRSLYEMQEERLARKAARGLNVGHLKLTFCSVGPTECAALAFVLQHLRRPVALQLDYNSVGDIGVEQLLPCLGVCKALYLRDNNISDRGICKLIECALHCEQLQKLALFNNKLTDGCAHSMAKLLACRQNFLALRLGNNYITAAGAQVLAEGLRGNTSLQFLGFWGNRVGDEGAQALAEALGDHQSLRWLSLVGNNIGSVGAQALALMLAKNVMLEELCLEENHLQDEGVCSLAEGLKKNSSLKILKLSNNCITYLGAEALLQALERNDTILEVWLRGNTFSLEEVDKLGCRDTRLLL

SEQ ID NO: 794713 - protein, 1040 aa, Homo sapiens; identical to SEQ ID NO: 794712

SEQ ID NO: 794714 - protein, 89 aa, Homo sapiens
MWPPQHSWGWDSVCGDSPASRPQLQATMTLDVKAEWWPLAWWVLRVRSSQAALVAQVVLKKKHLAKVPHADRRPRPRQHRADGGTAEPS

SEQ ID NO: 794715 - protein, 93 aa, Homo sapiens
SGSPLRSGKEGQVRAVAQPRLPAGSRFSTSPTPALTSPKEHPPLFLEVPGLRPPCGKFSVGVTSQRRAGLMPPFGLGGGAILIEIWQCRDRYT

SEQ ID NO: 794716 - protein, 110 aa, Homo sapiens
EKPARYRRAVSYDSKEYYMRLASGNPAIVQDAIVESSEGEAAQQEPEHGEDTIAKVKGLVKPPLKRSRSAPDGGDEENQEQLQDQIAEGSSIEEEEKTDNATLLRLLEEG

SEQ ID NO: 794717 - protein, 757 aa, Homo sapiens [sequence omitted]

SEQ ID NO: 794718 - protein, 759 aa, Homo sapiens
MMAALYPSTDLSGASSSSLPSSPSSSSPNEVMALKDVREVKEENTLNEKLFLLACDKGDYYMVKKILEENSSGDLNINCVDVLGRNAVTITIENENLDILQLLLDYGCQKLMERIQNPEYSTTMDVAPVILAAHRNNYEILTMLLKQDVSLPKPHAVGCECTLCSAKNKKDSLRHSRFRLDIYRCLASPALIMLTEEDPILRAFELSADLKELSLVEVEFRNDYEELARQCKMFAKDLLAQARNSRELEVILNHTSSDEPLDKRGLLEERMNLSRLKLAIKYNQKEFVSQSNCQQFLNTVWFGQMSGYRRKPTCKKIMTVLTVGIFWPVLSLCYLIAPKSQFGRIIHTPFMKFIIHGASYFTFLLLLNLYSLVYNEDKKNTMGPALERIDYLLILWIIGMIWSDIKRLWYEGLEDFLEESRNQLSFVMNSLYLATFALKVVAHNKFHDFADRKDWDAFHPTLVAEGLFAFANVLSYLRLFFMYTTSSILGPLQISMGQMLQDFGKFLGMFLLVLFSFTIGLTQLYDKGYTSKEQKDCVGIFCEQQSNDTFHSFIGTCFALFWYIFSLAHVAIFVTRFSYGEELQSFVGAVIVGTYNVVVVIVLTKLLVAMLHKSFQLIANHEDKEWKFARAKLWLSYFDDKCTLPPPFNIIPSPKTICYMISSLSKWICSHTSKGKVKRQNSLKEWRNLKQKRDENYQKVMCCLVHRYLTSMRQKMQSTDQATVENLNELRQDLSKFRNEIRDLLGFRTSKYAMFYPRN

SEQ ID NO: 794719 - protein, 759 aa, Homo sapiens; identical to SEQ ID NO: 794718

SEQ ID NO: 794720 - protein, 793 aa, Homo sapiens
MMAALYPSTDLSGASSSSLPSSPSSSSPNEVMALKDVREVKEENTLNEKLFLLACDKGDYYMVKKILEENSSGDLNINCVDVLGRNAVTITIENENLDILQLLLDYGCQSADALLVAIDSEVVGAVDILLNHRPKRSSRPTIVKLMERIQNPEYSTTMDVAPVILAAHRNNYEILTMLLKQDVSLPKPHAVGCECTLCSAKNKKDSLRHSRFRLDIYRCLASPALIMLTEEDPILRAFELSADLKELSLVEVEFRNDYEELARQCKMFAKDLLAQARNSRELEVILNHTSSDEPLDKRGLLEERMNLSRLKLAIKYNQKEFVSQSNCQQFLNTVWFGQMSGYRRKPTCKKIMTVLTVGIFWPVLSLCYLIAPKSQFGRIIHTPFMKFIIHGASYFTFLLLLNLYSLVYNEDKKNTMGPALERIDYLLILWIIGMIWSDIKRLWYEGLEDFLEESRNQLSFVMNSLYLATFALKVVAHNKFHDFADRKDWDAFHPTLVAEGLFAFANVLSYLRLFFMYTTSSILGPLQISMGQMLQDFGKFLGMFLLVLFSFTIGLTQLYDKGYTSKEQKDCVGIFCEQQSNDTFHSFIGTCFALFWYIFSLAHVAIFVTRFSYGEELQSFVGAVIVGTYNVVVVIVLTKLLVAMLHKSFQLIANHEDKEWKFARAKLWLSYFDDKCTLPPPFNIIPSPKTICYMISSLSKWICSHTSKGKVKRQNSLKEWRNLKQKRDENYQKVMCCLVHRYLTSMRQKMQSTDQATVENLNELRQDLSKFRNEIRDLLGFRTSKYAMFYPRN

SEQ ID NO: 794721 - protein, 264 aa, Homo sapiens
MGQMLQDFGKFLGMFLLVLFSFTIGLTQLYDKGYTSKEQKDCVGIFCEQQSNDTFHSFIGTCFALFWYIFSLAHVAIFVTRFSYGEELQSFVGAVIVGTYNVVVVIVLTKLLVAMLHKSFQLIANHEDKEWKFARAKLWLSYFDDKCTLPPPFNIIPSPKTICYMISSLSKWICSHTSKGKVKRQNSLKEWRNLKQKRDENYQKVMCCLVHRYLTSMRQKMQSTDQATVENLNELRQDLSKFRNEIRDLLGFRTSKYAMFYPRN

SEQ ID NO: 794722 - protein, 318 aa, Homo sapiens
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGEVSELNKQKITFEDSKVHAEQVLNDKENHIKTLTGHLPMMKDQAAVLEEDTTDDDNLELEVNSQWENGANLDDPLKGALKKL

SEQ ID NO: 794723 - protein, 187 aa, Homo sapiens
SIQVIFKKKVSLLNIATRITGGGKSGTVSSQKQPPSKATSDKTDSALNIATEIKDGLQCGTVSSQKQPALKATTDEEDSVSNIATEIKDGEKSGTVSSQKQPALKATTDEEDSVLNIATEIKDGEKSETVSSQKQPALKATTDEEDSVSIIATEIKDGEKSGTVSSRKKPALKATSDEKDSFSNITR

SEQ ID NO: 794724 - protein, 88 aa, Homo sapiens
LQTPHVLTLGFFLLPTPVPLTVLGDPLLVWESLDEVEGWSPCGGGGVSPRFAVGTGGGHSWLRRSGNSHSRGKSIHFVDAAANLVVVG

SEQ ID NO: 794725 - protein, 74 aa, Homo sapiens
LQERVGRVRESSRTAPVGCTSLTLLLPLKSSYLTACSKPVSWLQEDSHFFPEPSVMEGGPDFECLPQHAGLPVT

SEQ ID NO: 794726 - protein, 1324 aa, Homo sapiens
MGAPSACRTLVLALAAMLVVPQAETQGPVEPSWENAGHTMDGGAPTSSPTRRVSFVPPVTVFPSLSPLNPAHNGRVCSTWGDFHYKTFDGDVFRFPGLCNYVFSEHCRAAYEDFNVQLRRGLVGSRPVVTRVVIKAQGLVLEASNGSVLINGQREELPYSRTGLLVEQSGDYIKVSIRLVLTFLWNGEDSALLELDPKYANQTCGLCGDFNGLPAFNEFYAHNARLTPLQFGNLQKLDGPTEQCPDPLPLPAGNCTDEEGICHRTLLGPAFAECHALVDSTAYLAACAQDLCRCPTCPCATFVEYSRQCAHAGGQPRNWRCPELCPRTCPLNMQHQECGSPCTDTCSNPQRAQLCEDHCVDGCFCPPGTVLDDITHSGCLPLGQCPCTHGGRTYSPGTSFNTTCSSCTCSGGLWQCQDLPCPGTCSVQGGAHISTYDEKLYDLHGDCSYVLSKKCADSSFTVLAELRKCGLTDNENCLKAVTLSLDGGDTAIRVQADGGVFLNSIYTQLPLSAANITLFTPSSFFIVVQTGLGLQLLVQLVPLMQVFVRLDPAHQGQMCGLCGNFNQNQADDFTALSGVVEATGAAFANTWKAQAACANARNSFEDPCSLSVENENYARHWCSRLTDPNSAFSRCHSIINPKPFHSNCMFDTCNCERSEDCLCAALSSYVHACAAKGVQLSDWRDGVCTKYMQNCPKSQRYAYVVDACQPTCRGLSEADVTCSVSFVPVDGCTCPAGTFLNDAGACVPAQECPCYAHGTVLAPGEVVHDEGAVCSCTGGKLSCLGASLQKSTGCAAPMVYLDCSNSSAGTPGAECLRSCHTLDVGCFSTHCVSGCVCPPGLVSDGSGGCIAEEDCPCVHNEATYKPGETIRVDCNTCTCRNRRWECSHRLCLGTCVAYGDGHFITFDGDRYSFEGSCEYILAQDYCGDNTTHGTFRIVTENIPCGTTGTTCSKAIKLFVESYELILQEGTFKAVARGPGGDPPYKIRYMGIFLVIETHGMAVSWDRKTSVFIRLHQDYKGRVCGLCGNFDDNAINDFATRSRSVVGDALEFGNSWKLSPSCPDALAPKDPCTANPFRKSWAQKQCSILHGPTFAACRSQVDSTKYYEACVNDACACDSGGDCECFCTAVAAYAQACHDAGLCVSWRTPDTCPLFCDFYNPHGGCEWHYQPCGAPCLKTCRNPSGHCLVDLPGLEGCYPKCPPSQPFFNEDQMKCVAQCGCYDKDGNYYDVGARVPTAENCQSCNCTPSGIQCAHSLEACTCTYEDRTYSYQDVIYNTTDGLGACLIAICGSNGTIIRKAVACPGTPATTPFTFTTAWVPHSTTS

SEQ ID NO: 794727 - protein, 96 aa, Homo sapiens
TLRSPDVPVLVLTDADGPFFRCFSAVKPGTYYSNCMFDTCNCERSEDCLCAALSSYVHACAAKGVQLSDWRDGVCTKPMTTCPKSMTYHYHASTTN

SEQ ID NO: 794728 - protein, 465 aa, Homo sapiens
MAGVPSLAHCAPQEGICHRTLLGPAFAECHALVDSTAYLAACAQDLCRCPTCPCATFVEYSRQCAHAGGQPRNWRCPELCPRTCPLNMQHQECGSPCTDTCSNPQRAQLCEDHCVDGCFCPPGTVLDDITHSGCLPLGQCPCTHGGRTYSPGTSFNTTCSSCTCSGGLWQCQDLPCPGTCSVQGGAHISTYDEKLYDLHGDCSYVLSKKCADSSFTVLAELRKCGLTDNENCLKAVTLSLDGGDTAIRVQADGGVFLNSIYTQLPLSAANITLFTPSSFFIVVQTGLGLQLLVQLVPLMQVFVRLDPAHQGQMCGLCGNFNQNQADDFTALSGVVEATGAAFANTWKAQAACANARNSFEDPCSLSVENENYARHWCSRLTDPNSAFSRCHSIINPKPFHSNCMFDTCNCERSEDCLCAALSSYVHACAAKGVQLSDWRDGVCTKPMTTCPKSMTYHYHASTTNT

SEQ ID NO: 794729 - protein, 36 aa, Homo sapiens
LRGGAVAHIHARQPQFLCSFYSVTTVFPGGGECGGG

SEQ ID NO: 794730 - protein, 95 aa, Homo sapiens
RELEYQEIAPGMTESEIIGQGNASANKIQDQVAGIWESLAPQQMPLTTHKSGETGHQTTSGICEELHPLAISDIRKQSREQEKNAATSFLPSSFQ

SEQ ID NO: 794731 - protein, 465 aa, Homo sapiens
SPGYLQPWPMAVPGAEPAPLRALLRAGMTWIQTPSTTGRRRRELERVGAQRPEEGGGDTERGERGERGGRRAREQTPSRIQSPAAAKQQLRPRPCQSRCVRLAPLRLRPSGLPRMEDSQETSPSSNNSSEELSSALHLSKGMSIFLDILRRADKNDDGKLSFEEFKAYFADGVLSGEELHELFHTIDTHNTNNLDTEELCEYFSQHLGEYENVLAALEDLNLSILKAMGKTKKDYQEASNLEQFVTRFLLKETLNQLQSLQNSLECAMETTEEQTRQERQGPAKPEVLSIQWPGKRSSRRVQRHNSFSPNSPQFNVSGPGLLEEDNQWMTQINRLQKLIDRLEKKDLKLEPPEEEIIEGNTKSHIMLVQRQMSVIEEDLEEFQLALKHYVESASSQSGCLRISIQKLSNESRYMIYEFWENSSVWNSHLQTNYSKTFQRSNVDFLETPELTSTMLVPASWWILNN

SEQ ID NO: 794732 - protein, 579 aa, Homo sapiens
SPGYLQPWPMAVPGAEPAPLRALLRAGMTWIQTPSTTGRRRRELERVGAQRPEEGGGDTERGERGERGGRRARERTPSRIQSPAAAKQQLRPRPCQSRCVRLAPLRLRPSGLPRMEDSQETSPSSNNSSEELSSALHLSKGMSIFLDTYLTDDADQQLTDWTHTYSFDTTFKRTYFWHDLGDYISGRPPLTPTAISNTTLDYPTSLPYLHCLDPALDHEAYLLEPTLTPTTSAYERRRYLNDHLVRYDPDKLLHPEPTWTLSLYPHYPVDNGDERGRGHTQPPHRTKRHLNAQQTAQRTPFADKIDMEDNTNAMYLEITNHYSASCQVDTFSGTTEAHTKMPPLSNDSETELSEGNPVPVPLNNKQISPRTCGHTTWICAPTVIAHENKSTVGTGDKTAKEYTTPEIQQEGIQACAPTQEESHPKEAQKYETATNSPQRDPPGGKTRNQIAPNTPPGWHPPLGGTKHTTRTAPQQEPPCTPGNNLTKETAEHEPTKNNKQTLSPVSNHRKKDHTGGAHITKEKECYTRWISPDDRREPTHERKIKQISKTPKDTRDTQQTPKDRGDTLRKPPQEKRTQQ

SEQ ID NO: 794733 - protein, 450 aa, Homo sapiens
SPGYLQPWPMAVPGAEPAPLRALLRAGMTWIQTPSTTGRRRRELERVGAQRPEEGGGDTERGERGERGGRRAREQTPSRIQSPAAAKQQLRPRPCQSRCVRLAPLRLRPSGLPRMEDSQETSPSSNNSSEELSSALHLSKGMSIFLDILRRADKNDDGKLSFEEFKAYFADGVLSGEELHELFHTIDTHNTNNLDTEELCEYFSQHLGEYENVLAALEDLNLSILKAMGKTKKDYQEASNLEQFVTRFLLKETLNQLQSLQNSLECAMETTEEQTRQERQGPAKPEVLSIQWPGKRSSRRVQRHNSFSPNSPQFNVSGPGLLEEDNQWMTQINRLQKLIDRLEKKAKSHIMLVQRQMSVIEEDLEEFQLALKHYVESASSQSGCLRISIQKLSNESRYMIYEFWENSSVWNSHLQTNYSKTFQRSNVDFLETPELTSTMLVPASWWILNN

SEQ ID NO: 794734 - protein, 794 aa, Homo sapiens
KPDSWLEPLLLSTMAKTPSDHLLSTLEELVPYDFEKFKFKLQNTSVQKEHSRIPRSQIQRARPVKMATLLVTYYGEEYAVQLTLQVLRAINQRLLAEELHRAAIQEYSTQENGTDDSAASSSLGENKPRSLKTPDHPEGNEGNGPRPYGGGAASLRCSQPEAGRGLSRKPLSKRREKASEGLDAQGKPRTRSPALPGGRSPGPCRALEGGQAEVRLRRNASSAGRLQGLAGGAPGQKECRPFEVYLPSGKMRPRSLEVTISTGEKAPANPEILLTLEEKTAANLDSATEPRARPTPDGGASADLKEGPGNPEHSVTGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNVPELIGAQAHAVNVILDAETAYPNLIFSDDLKSVRLGNKWERLPDGPQRFDSCIIVLGSPSFLSGRRYWEVEVGDKTAWILGACKTSISRKGNMTLSPENGYWVVIMMKENEYQASSVPPTRLLIKEPPKRVGIFVDYRVGSISFYNVTARSHIYTFASCSFSGPLQPIFSPGTRDGGKNTAPLTICPVGGQGPD

SEQ ID NO: 794735 - protein, 323 aa, Homo sapiens
QIQAFQQVLFFQKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHSSELIGAQAHAVNVILDAETAYPNLIFSDDLKSVRLGNKWERLPDGPQRFDSCIIVLGSPSFLSGRRYWEVEVGDKTAWILGACKTSISRKGNMTLSPENGYWVVIMMKENEYQASSVPPTRLLIKEPPKRVGIFVDYRVGSISFYNVTARSHIYTFASCSFSGPLQPIFSPGTRDGGKNTAPLTICPVGGQGPD

SEQ ID NO: 794736 - protein, 913 aa, Homo sapiens
MKDSENKGASSPDMEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLMDGRHHQFWLVLCSFSVISTLLLAQPFDCYDAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTKPELDACDVPEKYPQLFQVTLDVELQPHDKVIDLTPPWEHYCTKDVNPSILFSSHQEHQDTLALGGQAPIDIPPDNPRHYGQSGFFASLCWQDQKSEKSFCEEDHAALVNQESEQSDDELLTLSSPHGNANGDKPHGVKKPSKKQQEPAAPPPPEDVDLLGLEGSAMSNSFSPPAAPPTNSELLSDLFGGGGAAGPTQAGQSGVEDVFHPSGPASTQSTPRRSATSTSASPTLRVGEGATFDPFGAPSKPSGQDLLGSFLNTSSASSDPFLQPTRSPSPTVHASSTPAVNIQPDVSGGWDWHAKPGGFGMGSKSAATSPTGSSHGTPTHQSKPQTLDPFADLGTLGSSSFASKPTTPTGLGGGFPPLSSPQKASPQPMGGGWQQGGAYNWQQPQPKPQPSMPHSSPQNRPNYNVSFSAMPGGQNERGKGSSNLEGKQKAADFEDLLSGQGFNAHKDKKGPRTIAEMRKEEMAKEMDPEKLKILEWIEGKERNIRALLSTMHTVLWAGETKWKPVGMADLVTPEQVKKVYRKAVLVVHPDKATGQPYEQYAKMIFMELNDAWSEFENQGQKPLY

SEQ ID NO: 794737 - protein, 173 aa, Homo sapiens
MFIFCNLYSTPGPAIRLLYAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTNLSEMHVMYQ

SEQ ID NO: 794738 - protein, 970 aa, Homo sapiens
LADARRRRRAVALGSGDRGGGGRGAPMGATEKGGQKSRKLFSLRRPWKATRRLWRPRSARQAAQGASSPDMEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLDGRAASSILVGAMFIFCNLYSTPGPAIRLLYAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTKPELDACDVPEKYPQLFQVTLDVELQPHDKVIDLTPPWEHYCTKDVNPSILFSSHQEHQDTLALGGQAPIDIPPDNPRHYGQSGFFASLCWQDQKSEKSFCEEDHAALVNQESEQSDDELLTLSSPHGNANGDKPHGVKKPSKKQQEPAAPPPPEDVDLLGLEGSAMSNSFSPPAAPPTNSELLSDLFGGGGAAGPTQAGQSGVEDVFHPSGPASTQSTPRRSATSTSASPTLRVGEGATFDPFGAPSKPSGQDLLGSFLNTSSASSDPFLQPTRSPSPTVHASSTPAVNIQPDVSGGWDWHAKPGGFGMGSKSAATSPTGSSHGTPTHQSKPQTLDPFADLGTLGSSSFASKPTTPTGLGGGFPPLSSPQKASPQPMGGGWQQGGAYNWQQPQPKPQPSMPHSSPQNRPNYNVSFSAMPGGQNERGKGSSNLEGKQKAADFEDLLSGQGFNAHKDKKGPRTIAEMRKEEMAKEMDPEKLKILEWIEGKERNIRALLSTMHTVLWAGETKWKPVGMADLVTPEQVKKVYRKAVLVVHPDKATGQPYEQYAKMIFMELNDAWSEFENQGQKPLY

SEQ ID NO: 794739 - protein, 900 aa, Homo sapiens
MEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLMDGRHHQFWLVLCSFSVISTLLLAQPFDCYDAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTKPELDACDVPEKYPQLFQVTLDVELQPHDKVIDLTPPWEHYCTKDVNPSILFSSHQEHQDTLALGGQAPIDIPPDNPRHYGQSGFFASLCWQDQKSEKSFCEEDHAALVNQESEQSDDELLTLSSPHGNANGDKPHGVKKPSKKQQEPAAPPPPEDVDLLGLEGSAMSNSFSPPAAPPTNSELLSDLFGGGGAAGPTQAGQSGVEDVFHPSGPASTQSTPRRSATSTSASPTLRVGEGATFDPFGAPSKPSGQDLLGSFLNTSSASSDPFLQPTRSPSPTVHASSTPAVNIQPDVSGGWDWHAKPGGFGMGSKSAATSPTGSSHGTPTHQSKPQTLDPFADLGTLGSSSFASKPTTPTGLGGGFPPLSSPQKASPQPMGGGWQQGGAYNWQQPQPKPQPSMPHSSPQNRPNYNVSFSAMPGGQNERGKGSSNLEGKQKAADFEDLLSGQGFNAHKDKKGPRTIAEMRKEEMAKEMDPEKLKILEWIEGKERNIRALLSTMHTVLWAGETKWKPVGMADLVTPEQVKKVYRKAVLVVHPDKATGQPYEQYAKMIFMELNDAWSEFENQGQKPLY

SEQ ID NO: 794740 - protein, 240 aa, Homo sapiens
MLHHNRSTAAALGSSSFASKPTTPTGLGGGFPPLSSPQKASPQPMGGGWQQGGAYNWQQPQPKPQPSMPHSSPQNRPNYNVSFSAMPGGQNERGKGSSNLEGKQKAADFEDLLSGQGFNAHKDKKGPRTIAEMRKEEMAKEMDPEKLKILEWIEGKERNIRALLSTMHTVLWAGETKWKPVGMADLVTPEQVKKVYRKAVLVVHPDKATGQPYEQYAKMIFMELNDAWSEFENQGQKPLY

SEQ ID NO: 794741 - protein, 970 aa, Homo sapiens; identical to SEQ ID NO: 794738

SEQ ID NO: 794742 - protein, 970 aa, Homo sapiens; identical to SEQ ID NO: 794738

SEQ ID NO: 794743 - protein, 949 aa, Homo sapiens
LADARRRRRAVALGSGDRGGGGRGAPMGATEKGGQKSRKLFSLRRPWKATRRLWRPRSARQAAQGASSPDMEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLDGRAASSILVGAMFIFCNLYSTPGPAIRLLYAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTKPELDACDVPEKYPQLFQVTLDVELQPHDKVIDLTPPWEHYCTKDVNPSILFSSHQEHQDTLALGGQAPIDIPPDNPRHYGQSGFFASLCWQDQKSEKSFCEEDHAALVNQESEQSDDELLTLSSPHGNANGDKPHGVKKPSKKQQEPAAPPPPEDVDLLGLEGSAMSNSFSPPAAPPTNSELLSDLFGGGGAAGPTQAGQSGVEDVFHPSGPASTQSTPRRSATSTSASPTLRVGEGATFDPFGAPSKPSGQDLLGSFLNTSSASSDPFLQPTRSPSPTVHASSTPAVNIQPDVSGGWDWHAKPGGFGMGSKSAATSPTGSSHGTPTHQSKPQTLDPFADLGTLGSSSFASKPTTPTGLGGGFPPLSSPQKASPQPMGGGWQQGGAYNWQQPQPKPQPSMPHSSPQNRPNYNVSFSAMPGGQNERGKGSSNLEGKQKAADFEDLLSGQGFNAHKDKKGPRTIAEMRKEEMAKEMDPEKLKILEWIEGKERNIRALLSTMHTVLWAGETKWKPVGMADPVRWLVSICSEEPGPTSPQGKSRPIKLLQWAFLF

SEQ ID NO: 794744 - protein, 248 aa, Homo sapiens
LADARRRRRAVALGSGDRGGGGRGAPMGATEKGGQKSRKLFSLRRPWKATRRLWRPRSARQAAQGASSPDMEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLVSNLLLLVVMVWFGQIWMSLYTMVDR

SEQ ID NO: 794745 - protein, 91 aa, Homo sapiens
LPALGSGQQEALRELELTLLCFCFCFCSVRSLRLPLASIPHERHPCGFRRSRVNLGEKRGTQGGDLRACLIHPWTSLPETKWAAHLCDPQS

SEQ ID NO: 794746 - protein, 262 aa, Homo sapiens
GLNGPSSRNRRDGFCRKRRTGCSGPFQATQLWDGIIHSLQAQVEIKRRRHHLQTYKDCFTGSDAVDVVLSHLMQNTCLSSNDISCLKGVHLCQVLMNHKVFEPVGMKKLFKKEKELEFEDSNISLYRFLGNKSSYDCCKRQKDAENEFNETLRPGYEMISNPLAQEIGEERIEELIHTINGNPALCPNITVQKPFLRLSKEDVWKEQTLLCLLQLIHLPFLDNILEPPVKTQNLQLNKEEDLVITNTCLDRELIPSLCLPEK

SEQ ID NO: 794747 - protein, 262 aa, Homo sapiens; identical to SEQ ID NO: 794746

SEQ ID NO: 794748 - protein, 262 aa, Homo sapiens; identical to SEQ ID NO: 794746

SEQ ID NO: 794749 - protein, 571 aa, Homo sapiens
PFPHCGVIRGCPHSHNAPGSQRCWAPGQPLPGKFSLGTSGGYYRPYSRPYGLWNLTTGGRAGPDGDITCGVSPMDETEWIHRHPKAEDLRVGLISWAGTYLTFEACKNTVTATAKSLGRRQTWEILVSNEHETQAVVRLKSVQGLYLLCECDGTVCYGRPRTSHHGCFLLRFHRNSKWTLQCLISGRYLESNGKDVFCTSHVLSAYHMWTPRPALHVHVILYSPIHRCYARADPTMGRIWVDAAVPCLEECGFLLHFRDGCYHLETSTHHFLSHVDRLFSQPSSQTAFHMQVRPGGLVALCDGEGGMLYPQGTHLLLGMGCNPMRGEEWFILQHCPTWVSLRSKTGRFISVIYDGEVRAASERLNRMSLFQFECDSESPTVQLRSANGYYLSQRRHRAVMADGHPLESDTFFRMHWNCGRIILQSCRGRFLGIAPNSLLMANVILPGPNEEFGILFANRSFLVLRGRYGYVGSSSGHDLIQCNQDQPDRIHLLPCRPGIYHFQAQGGSFWSITSFGTFRPWGKFALNFCIELQGSNLLTVLAPNGFYMRADQSGTLLADSEDITRECIWEF

SEQ ID NO: 794750 - protein, 404 aa, Homo sapiens
PFPHCGVIRGCPHSHNAPGSQRCWAPGQPLPGKFSLGTSGGYYRPYSRPYGLWNLTTGGRAGPDGDITCGVSPMDETEWIHRHPKAEDLRVGLISWAGTYLTFEACKNTVTATAKSLGRRQTWEILVSNEHETQAVVRLKSVQGLYLLCECDGTVCYGRPRTSHHGCFLLRFHRNSKWTLQCLISGRYLESNGKDVFCTSHVLSAYHMWTPRPALHVHVILYSPIHRCYARADPTMGRIWVDAAVPCLEECGFLLHFRDGCYHLETSTHHFLSHVDRLFSQPSSQTAFHMQVRPGGLVALCDGEGGMLYPQGTHLLLGMGCNPMRGEEWFILQHCPTWVSLRSKTGRFISVIYDGEVRAASERLNRMSLFQFECDSESPTVQLRSANGYYLSQVRPWLPEQEKP

SEQ ID NO: 794751 - protein, 474 aa, Homo sapiens
MLPGHRGAGPQASLCLGSSLWEHLTWEILVSNEHETQAVVRLKSVQGLYLLCECDGTVCYGRPRTSHHGCFLLRFHRNSKWTLQCLISGRYLESNGKDVFCTSHVLSAYHMWTPRPALHVHVILYSPIHRCYARADPTMGRIWVDAAVPCLEECGFLLHFRDGCYHLETSTHHFLSHVDRLFSQPSSQTAFHMQVRPGGLVALCDGEGGMLYPQGTHLLLGMGCNPMRGEEWFILQHCPTWVSLRSKTGRFISVIYDGEVRAASERLNRMSLFQFECDSESPTVQLRSANGYYLSQRRHRAVMADGHPLESDTFFRMHWNCGRIILQSCRGRFLGIAPNSLLMANVILPGPNEEFGILFANRSFLVLRGRYGYVGSSSGHDLIQCNQDQPDRIHLLPCRPGIYHFQAQGGSFWSITSFGTFRPWGKFALNFCIELQGSNLLTVLAPNGFYMRADQSGTLLADSEDITRECIWEF

SEQ ID NO: 794752 - protein, 658 aa, Homo sapiens
PFPHCGVIRGCPHSHNAPGSQRCWAPGQPLPGKFSLGTSGGYYRPYSRPYGLWNLTTGGRAGPDGDITCGVSPMDETEWIHRHPKAEDLRVGLISWAGTYLTFEACKNTVTATAKSLGRRQHRVVVSERREVESTGWLCQKEEKWRAQVDQQLNQAVASELFMLPSSSLEPGPAYKSFCFCLAMLEGNLWGWRYWLSVLSADNSEEEKTWEILVSNEHETQAVVRLKSVQGLYLLCECDGTVCYGRPRTSHHGCFLLRFHRNSKWTLQCLISGRYLESNGKDVFCTSHVLSAYHMWTPRPALHVHVILYSPIHRCYARADPTMGRIWVDAAVPCLEECGFLLHFRDGCYHLETSTHHFLSHVDRLFSQPSSQTAFHMQVRPGGLVALCDGEGGMLYPQGTHLLLGMGCNPMRGEEWFILQHCPTWVSLRSKTGRFISVIYDGEVRAASERLNRMSLFQFECDSESPTVQLRSANGYYLSQRRHRAVMADGHPLESDTFFRMHWNCGRIILQSCRGRFLGIAPNSLLMANVILPGPNEEFGILFANRSFLVLRGRYGYVGSSSGHDLIQCNQDQPDRIHLLPCRPGIYHFQAQGGSFWSITSFGTFRPWGKFALNFCIELQGSNLLTVLAPNGFYMRADQSGTLLADSEDITRECIWEF

SEQ ID NO: 794753 - protein, 142 aa, Homo sapiens
MQSFPRFPLLSTGKGASPHGHHHHRPTGSTAMLLSMFSSGPRNLQSACKCYLTWDSPFIAVSVPLNVQDPRPGIRNSKSPLGAIPVAKLVPNVQESSLLFPLLFSSRRNSPHSHHSWEYAESHKKPASLRVSPKVHSLLLRY

SEQ ID NO: 794754 - protein, 198 aa, Homo sapiens
MATLWGGLLRLGSLLSLSCLALSVLLLAQLSDAAKNFEDVRCKCICPPYKENSGHIYNKNISQKDCDCLHVVEPMPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYAQQRWKLQVQEQRKSVFDRHVVLS

SEQ ID NO: 794755 - protein, 198 aa, Homo sapiens; identical to SEQ ID NO: 794754

SEQ ID NO: 794756 - protein, 124 aa, Homo sapiens
MPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYAQQRWKLQVQEQRKSVFDRHVVLS

SEQ ID NO: 794757 - protein, 124 aa, Homo sapiens; identical to SEQ ID NO: 794756

SEQ ID NO: 794758 - protein, 198 aa, Homo sapiens; identical to SEQ ID NO: 794754

SEQ ID NO: 794759 - protein, 198 aa, Homo sapiens; identical to SEQ ID NO: 794754

SEQ ID NO: 794760 - protein, 198 aa, Homo sapiens; identical to SEQ ID NO: 794754

SEQ ID NO: 794761 - protein, 198 aa, Homo sapiens; identical to SEQ ID NO: 794754

SEQ ID NO: 794762 - protein, 198 aa, Homo sapiens; identical to SEQ ID NO: 794754

SEQ ID NO: 794763 - protein, 182 aa, Homo sapiens
AQRIRKPTGCCGQEARGRQNFEDVRCKCICPPYKENSGHIYNKNISQKDCDCLHVVEPMPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYAQQRWKLQVQEQRKSVFDRHVVLS

SEQ ID NO: 794764 - protein, 196 aa, Homo sapiens
MSRRSMLLAWALPSLLRLGAAQETEDPACCSPIVPRNEWKALASECAQHLSLPLRYVVVSHTAGSSCNTPASCQQQARNVQHYHMKTLGWCDVGYNFLIGEDGLVYEGRGWNFTGAHSGHLWNPMSIGISFMGNYMDRVPTPQAIRAAQGLLACGVAQGALRSNYVLKGHRDVQRTLSPGNQLYHLIQNWPHYRSP

SEQ ID NO: 794765 - protein, 208 aa, Homo sapiens
FADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTVRLRLPPLLRGD

SEQ ID NO: 794766 - protein, 47 aa, Homo sapiens
TATAAFGARDSGEFRRAPAPPPLPPAEPLAKEKPGTPPGPPPPDTNS

SEQ ID NO: 794767 - protein, 114 aa, Homo sapiens
HAHRTGPSRRPRLWRPGVDGSCSTKPGQPPSQPVTTPQHLDPAHPLESSAWGPRDAPPPESPLHPPLEEQAAAAPPSASIALTLFPPDGARGCFPAGILRSSFPWWLGCLSLHY

SEQ ID NO: 794768 - protein, 120 aa, Homo sapiens
NKRTPEHPVPYGTIPEPPLPAEPSNKRTPEHPVPNGTIPEPPLLTEPPNKRTPEHPVPDGTIPEPPLATEPSSETTPEHPVPSGTIPEPPLLTEPSNKRTSEHPVPDRTIPGPPLPIEPH

SEQ ID NO: 794769 - protein, 91 aa, Homo sapiens
VSDTSVMKAWVILLVEAAAGGEGNLESIVEETMDTSCSPASCRSDAVVVHSTNLSFHRIPGGAAPGTYMEDPCLARSGLWQTPRCATLPTF

SEQ ID NO: 794770 - protein, 63 aa, Homo sapiens
GRSALLPGQPPTPPAPLHSAQLARRKLSCSRPATPRLRRFATLALGRSGSGAFGMAAPSGPAR

SEQ ID NO: 794771 - protein, 303 aa, Homo sapiens
IQGTDKEGGAKGEQQPISSPWDVVFGTSGSEVQRGDILWIAMAGTHQIWALLLDSGKLPKKNELTKGTCLRFAGSGNEENRNNAYPHKAGFAQPSGLSLASEDPWSCLFVADSESSTVRTVSLKDGAVKHLVGGERDPMNLFAFGDVDGVGINAKLQHPLGVTWDKKRNLLYVADSYNHKIKVVDPKTKNCTTLAGTGDTNNVTSSSFTESTFNEPGGLCIGENGELLYVADTNNHQIKVMDLETKMVSVLPIFRSENAVVDGPFLVEKQKTLPKLPKSAPSIRLSPVTACAGQTLQFKLRLD

SEQ ID NO: 794772 - protein, 237 aa, Homo sapiens
DKEWMPVTKLGRFVKDMKIKSLEEIYVFSLPIKESEIIDSFLGASLKDEVLKIMPVQKQTRVGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 794773 - protein, 168 aa, Homo sapiens
PPPQLRGPPPGPWTAQPSGRLERGAGPRSTPEVSASKVRHHVLGYSQCEATLGPSEQPLLTSGVTLPKTHCPIMAGDRLPRKVMDAKKLASLLRGGPGGGLVIDSHSFLEYNSWHVLSSVNICCSKLVKWRLQKGKVTIVEFIQPAARSQVEATEPQDVVVYDQSTRP

SEQ ID NO: 794774 - protein, 104 aa, Homo sapiens
TVYLHLPPSASVFGSSVKADMLPKTRGESLEAGEDGQVLGVEVASCPSSSPTTGAWRRLTAAITVTFHSLSSTQPALRGGSRDWSTQQQQPCPHLLLQQQLYLI

SEQ ID NO: 794775 - protein, 701 aa, Homo sapiens
MATYKVRVATGTDLLSGTRDSISLTIVGTQGESHKQLLNHFGRDFATGAVGQYTVQCPQDLGELIIIRLHKERYAFFPKDPWYCNYVQICAPNGRIYHFPAYQWMDGYETLALREATGKTTADDSLPVLLEHRKEEIRAKQDFYHWRVFLPGLPSYVHIPSYRPPVRRHRNPNRPEWNGYIPGFPILINFKATKFLNLNLRYSFLKTASFFVRLGPMALAFKVRGLLDCKHSWKRLKDIRKIFPGKKSVVSEYVAEHWAEDTFFGYQYLNGVNPGLIRRCTRIPDKFPVTDDMVAPFLGEGTCLQAELEKGNIYLADYRIMEGIPTVELSGRKQHHCAPLCLLHFGPEGKMMPIAIQLSQTPGPDCPIFLPSDSEWDWLLAKTWVRYAEFYSHEAIAHLLETHLIAEAFCLALLRNLPMCHPLYKLLIPHTRYTVQINSIGRAVLLNEGGLSAKGMSLGVEGFAGVMVRALSELTYDSLYLPNDFVERGVQDLPGYYYRDDSLAVWNALEKYVTEIITYYYPSDAAVEGDPELQSWVQEIFKECLLGRESSGFPRCLRTVPELIRYVTIVIYTCSAKHAAVNTGQMEFTAWMPNFPASMRNPPIQTKGLTTLETFMDTLPDVKTTCITLLVLWTLSREPDDRRPLGHFPDIHFVEEAPRRSIEAFRQRLNQISHDIRQRNKCLPIPYYYLDPVLIENSISI

SEQ ID NO: 794776 - protein, 114 aa, Homo sapiens
AAAVILEDPGTSGPEQDVPGGGVGWVRGYRGTYWDPRGPEGVPGMPVRLQDLPPSSQGMSLGVEGFAGVMVRALSELTYDSLYLPNDFVERGVQDLPGYYYRDDSLAVWNALEK

SEQ ID NO: 794777 - protein, 653 aa, Homo sapiens
MATYKVRVATGTDLLSGTRDSISLTIVGTQGESHKQLLNHFGRDFATGAVGQYTVQCPQDLGELIIIRLHKERYAFFPKDPWYCNYVQICAPNGRIYHFPAYQWMDGYETLALREATGKTTADDSLPVLLEHRKEEIRAKQDFYHWRVFLPGLPSYVHIPSYRPPVRRHRNPNRPEWNGYIPGFPILINFKATKFLNLNLRYSFLKTASFFVRLGPMALAFKVRGLLDCKHSWKRLKDIRKIFPGKKSVVSEYVAEHWAEDTFFGYQYLNGVNPGLIRRCTRIPDKFPVTDDMVAPFLGEGTCLQAELELSQTPGPDCPIFLPSDSEWDWLLAKTWVRYAEFYSHEAIAHLLETHLIAEAFCLALLRNLPMCHPLYKLLIPHTRYTVQINSIGRAVLLNEGGLSAKGMSLGVEGFAGVMVRALSELTYDSLYLPNDFVERGVQDLPGYYYRDDSLAVWNALEKYVTEIITYYYPSDAAVEGDPELQSWVQEIFKECLLGRESSGFPRCLRTVPELIRYVTIVIYTCSAKHAAVNTGQMEFTAWMPNFPASMRNPPIQTKGLTTLETFMDTLPDVKTTCITLLVLWTLSREPDDRRPLGHFPDIHFVEEAPRRSIEAFRQRLNQISHDIRQRNKCLPIPYYYLDPVLIENSISI

SEQ ID NO: 794778 - protein, 69 aa, Homo sapiens
AENVKLNNNQSVCKAQQEIKWRRRWVAFTFACDEILISALSPEALSSLLCLGCTLPQAPSQAACLPRLL

SEQ ID NO: 794779 - protein, 84 aa, Homo sapiens
ILLFPLDSQLDHITFPAFLPTFSKRDWVLANGMRVEERVPLSGLAHKNLTENSPPYSFSFHELNGNDFGELGSNVLKIGNSLSA

SEQ ID NO: 794780 - protein, 224 aa, Homo sapiens
MAAAVPQRAWTVEQLRSEQLPKKDIIKFLQEHGSDSFLAEHKLLGNIKNVAKTANKDHLVTAYNHLFETKRFKGTESISKVSEQVKNVKLNEDKPKETKSEETLDEGPPKYTKSVLKKGDKTNFPKKGDVVHCWYTGTLQDGTVFDTNIQTSAKKKKNAKPLSFKVGVGKVIRGWDEALLTMSKGEKARLEIEPEWAYGKKGQPDAKIPPNAKLTFEVELVDID

SEQ ID NO: 794781 - protein, 224 aa, Homo sapiens; identical to SEQ ID NO: 794780

SEQ ID NO: 794782 - protein, 224 aa, Homo sapiens; identical to SEQ ID NO: 794780

SEQ ID NO: 794783 - protein, 224 aa, Homo sapiens; identical to SEQ ID NO: 794780

SEQ ID NO: 794784 - protein, 224 aa, Homo sapiens; identical to SEQ ID NO: 794780

SEQ ID NO: 794785 - protein, 211 aa, Homo sapiens
MAAAVPQRAWTVEQLRSEQLPKKFLAEHKLLGNIKNVAKTANKDHLVTAYNHLFETKRFKGTESISKVSEQVKNVKLNEDKPKETKSEETLDEGPPKYTKSVLKKGDKTNFPKKGDVVHCWYTGTLQDGTVFDTNIQTSAKKKKNAKPLSFKVGVGKVIRGWDEALLTMSKGEKARLEIEPEWAYGKKGQPDAKIPPNAKLTFEVELVDID

SEQ ID NO: 794786 - protein, 198 aa, Homo sapiens
MAAAVPQRAWTVEQLRSEQLPKKDIIKFLQEHGSDSFLAEHKLLGNIKNVAKTANKDHLVTAYNHLFETKRFKGTESISKVSEQVKNVKLNEDKPKETKSEETLDEGPPKYTKSVLKKGDKTNFPKKGDVVHCWYTGTLQDGTVFDTNIQTSAKKKKNAKPLSFKVGVGKVIRGWDEALLTMSKGEKARNSTKCKTHF

SEQ ID NO: 794787 - protein, 507 aa, Homo sapiens
MAAAVPQRAWTVEQLRSEQLPKKDIIKFLQEHGSDSFLAEHKLLGNIKNVAKTANKDHLVTAYNHLFETKRFKGTESISKVSEQVKNVKLNEDKPKETKSEETLDEGPPKYTKSVLKKGDKTNFPKKGDVVHCWYTGTLQDGTVFDTNIQTSAKKKKNAKPLSFKVGVGKVIRGWDEALLTMSKGEKARLEIEPEWAYGKKGQPDAKYPFFPFIIKVEKKKQKKQPQHKTKKKHTTTKQNNNNSATPTTNTTERPPKQRANTERRAKRRETQRREDQLVYTKEADESKTAGRKRRKHEEKGDKNTGKESAWKKTKHKHNEELTNQRCKTIQTRAKRKNIETQVNECNLRRNQKRGRDSNAARTEHEEQKRETKTDTDIKARGHRRRKKDEKPKRRRAEKQRKQRESRDTTQETSQPKEPAEKKEEGKTINHEASDERKTRGKDADKAEGEERNRETRGERRKRREAETRRKEKKDQRKRTGTEKTQKRSDKTKKRNRREEEYSDGKS

SEQ ID NO: 794788 - protein, 230 aa, Homo sapiens
MAAAVPQRAWTVEQLRSEQLPKKDIIKFLQEHGSDSFLAEHKLLGNIKNVAKTANKDHLVTAYNHLFETKRFKGTESISKVSEQVKNVKLNEDKPKETKSEETLDEGPPKYTKSVLKKGDKTNFPKKGDVVHCWYTGTLQDGTVFDTNIQTSAKKKKNAKPLSFKVGVGKVIRGWDEALLTMSKGEKARLEIEPEWAYGKKGQPDAKSKILSYSCVKYWSRRTFSFYLML

SEQ ID NO: 794789 - protein, 198 aa, Homo sapiens; identical to SEQ ID NO: 794786

SEQ ID NO: 794790 - protein, 130 aa, Homo sapiens [sequence omitted]

SEQ ID NO: 794791 - protein, 339 aa, Homo sapiens
MQWALPVGQGAGAHVVEGVRSCLPHRKALLVSTTSWLAFGTGWPSIICHQVHCGVFCVSMAGVLQYTHTVHVLFIARARVEVSREQSSMIMYCVRPLHLVNFLFFLKINNNKIRKMAAAVPQRAWTVEQLRSEQLPKKDIIKFLQEHGSDSFLAEHKLLGNIKNVAKTANKDHLVTAYNHLFETKRFKGTESISKVSEQVKNVKLNEDKPKETKSEETLDEGPPKYTKSVLKKGDKTNFPKKGDVVHCWYTGTLQDGTVFDTNIQTSAKKKKNAKPLSFKVGVGKVIRGWDEALLTMSKGEKARLEIEPEWAYGKKGQPDAKIPPNAKLTFEVELVDID

SEQ ID NO: 794792 - protein, 116 aa, Homo sapiens
LRQSLALSLRLECSGMISVHRSLHLPGSSDFPASAFRVAGITGTHHDVRLIFEFLLVEMGLHCVGQADLKLLTSNDPPALASQSAGITGMSHHAQPIDILYQVEEFPLLLYQEGFL

SEQ ID NO: 794793 - protein, 186 aa, Homo sapiens
PNGEERRCRDTREEPPQPPPPRCGARVSAAPARPAAGQHGGCTARAAVAAAAGAVRLPGPRRRYMYWADWGETPWIEQVGMDDSTQKIIVDLDIYWPNRLTIDLGEKKLYWADTKLGFIHRANLDGSFRQKVVKGSLTHPFTLTLSGDTLHWMDWLTCSIHACNRNTAGKRNEILSALYSAWISRC

SEQ ID NO: 794794 - protein, 186 aa, Homo sapiens; identical to SEQ ID NO: 794793

SEQ ID NO: 794795 - protein, 30 aa, Homo sapiens
MRTISRRDGRLSMAGLASTSLFCHSFSAPP

SEQ ID NO: 794796 - protein, 120 aa, Homo sapiens
MTWLQTLTGLLEQMQVHRDAESQLVLQEWKKERKEMREMTKSFFNAQFGSLFRTDQNPTYFLRRLSRFADIYMASLSCLLNYDVSHTFYPRRTPLQHELPAWSERPPTFGTPLLQEAQAK

SEQ ID NO: 794797 - protein, 120 aa, Homo sapiens; identical to SEQ ID NO: 794796

SEQ ID NO: 794798 - protein, 120 aa, Homo sapiens; identical to SEQ ID NO: 794796

SEQ ID NO: 794799 - protein, 66 aa, Homo sapiens
MTKSFFNAQFGSLFRTDQNPTYFLRRLSRFADIYMASLSCLLNYDVSHTFYPRRTPLQHELPAWSE

SEQ ID NO: 794800 - protein, 31 aa, Homo sapiens
ILNEAISKQREEAQVGSIARSQMVAQRKKRC

SEQ ID NO: 794801 - protein, 248 aa, Homo sapiens
MSRGGPTTSILPSVGTPCSPAETRKPNTFPKLLSAECLEVASVLSSDARFMVWKEGAPVSVGVRHIPNLQLKTAILFWSYFRVRNSGRGLWGNSFLSLSYECVQKSLGCESKMGTHEAGALAGLLPGRHTWCLQSGAHRVLGFSAWGWSPLVEPPKMSGGSCRAFLTWPQEPCASTPFSDLTSPWDSPTELAELLKAVAEGGGTLGAAAARGVWLPRRRGDWALGVFGATQAEILETLTSAGMQAFRS

SEQ ID NO: 794802 - protein, 337 aa, Homo sapiens
MRAVFIQGAEEHPAAFCYQVNGSCPRTVHTLGIQLVIYLTCAAGMLIIVLGNVFVAFAVSYFKALHTPTNFLLLSLALADMFLGLLVLPLSTIRSVESCWFFGDFLCRLHTYLDTLFCLTSIFHLCFISIDRHCAICDPLLYPSKFTVRVALRYILAGWGVPAAYTSLFLYTDVVETRLSQWLEEMPCVGSCQLLLNKFWGWLNFPLFFVPCLIMISLYVKIFVVATRQAQQITTLSKSLAGAAKHERKAAKTLGIVVGIYLLCWLPFTIDTMVDSLLHFITPPLVFDIFIWFAYFNSACNPIIYVFSYQWFRKALKLTLSQKVFSPQTRTVDLYQE

SEQ ID NO: 794803 - protein, 142 aa, Homo sapiens
AFYFIFILRQCLTLSPRLWSAMAGGTAASTSWASSCAPISASQVAETTEKHHHAQLIFIFFVEMGFCHVAQAGLELLSSSSPSASASQSARIIGMSHCACPHCSFDLHFRNDSDGEHLFRCLLATCTPSLGKHLKAFATLIF

SEQ ID NO: 794804 - protein, 101 aa, Homo sapiens
ETESCSVTQAGVQWCDLHSLQPPPPEFKRFSCLSLPSSWDYGTCHHAWLIFIFLVETGFHHVGQAGLKLLFSSDPPASASQSAGITSMSHYAQPNLPIYRL

SEQ ID NO: 794805 - protein, 67 aa, Homo sapiens
GTLTFAPFLPEYQLTSIWGLNMGQIPEKGGWGTKTNTNSANGASTAICLQPQAAREVHGLGTPRSRM

SEQ ID NO: 794806 - protein, 290 aa, Homo sapiens
ILTGNKVLMPCDAVLIEGSCVVDEGMLTGESIPVTKTPLPKMDSSVPWKTQSEADYKRHVLFCGTEVIQAKAACSGTVRAVVLQTGFNTAKGDLVRSILYPKPVNFQLYRDAIRFLLCLVGTATIGMIYTLCVYVLSGEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWVSLCSSENLRSFFNARAT

SEQ ID NO: 794807 - protein, 465 aa, Homo sapiens
ILTGNKVLMPCDAVLIEGSCVVDEGMLTGESIPVTKTPLPKMDSSVPWKTQSEADYKRHVLFCGTEVIQAKAACSGTVRAVVLQTGFNTAKGDLVRSILYPKPVNFQLYRDAIRFLLCLVGTATIGMIYTLCVYVLSGEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWEMAFSGDDFHIKGVPAHAMVVKPCRTASQVPVEGIAILHQFPFSSALQRMTVIVQEMGGDRLAFMKGAPERVASFCQPETVPTSFVSELQIYTTQGFRVIALAYKKLENDHHATTLTRETVESDLIFLGLLILENRLKEETKPVLEELISARIRTVMITGDNLQTAITVARKSGMVSESQKVILIEANETTGS

SEQ ID NO: 794808 - protein, 106 aa, Homo sapiens
SVAGVTGQGGGLLCGSSPLQGTQSGARGAEHEAVAPDPPTASAPPLPAAAGSPGPGGQEKPHLWLSTKPTAQPRCTDAVTCTPVHTHPEMATGLVDFSPDWAPRSF

SEQ ID NO: 794809 - protein, 162 aa, Homo sapiens
VQWVPNCRQCSEGDFHGIMEVCDRGTSLIQGVVKEGFLEVGTLESKPEEHLAVNWAEERGWDRDRTFQAEGSLLCKAPEIGRCLRHLKIADVAVVGGAGERGIGERREVHTEPRRPYWILIMVWRAGPRGQQALQLLQIPTMAPITLYDGPSPVQPHPHTLE

SEQ ID NO: 794810 - protein, 130 aa, Homo sapiens
MQVAGHGEDFLTSAGKRAQRRNPRIRKALCTCNKSLTVSARLEWHDLGSLQPPSPGLKQFSCLSLQSSWDYRFCMRSTSYVQLCSGGPTGLRASACSKRLHRSKHSHHNTRCNIFPGPLTIFSIKAIITR

SEQ ID NO: 794811 - protein, 258 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALYHRFSLCYVDIAIACNNKGAHSVGLMWWTPAREVLRMRGTISCEHPWEVMPDLYFYRDPEEIEKEEQAAAKKAVTKKEFQGEWTASAPEFTATQPEVADWSEGMQVPSVTI

SEQ ID NO: 794812 - protein, 42 aa, Homo sapiens
GKTCVVQHFKSGVYTETQQNTIGVDFTVRSLDIDGKKVKVRG

SEQ ID NO: 794813 - protein, 599 aa, Homo sapiens
MLCLGWIFLWLVAGERIKGFNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHFLTPGVNNSGSYICRPKMIKSPYDVACCVKMILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 794814 - protein, 457 aa, Homo sapiens
MILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 794815 - protein, 97 aa, Homo sapiens
ILGTIYHHMPVLRQKEESFQFILEAISQIASFHMDTVVVNLLQKPLPFDRDTKTLWKALAEKPASSGKLLQALIDKLETELEDDIARVEAISVSWTA

SEQ ID NO: 794816 - protein, 100 aa, Homo sapiens
WDSNVFSGLLRAFSEFTHMHHTHHVAFPKPPGPRDPFCPELLEGPAFLGLGPCRCTAGLRVPSFSQRPDLAVDGCRARDGLTNSAEVSRIPLRSHEFRVV

SEQ ID NO: 794817 - protein, 122 aa, Homo sapiens
NSMISALFSAVSDCKEVIPPAHKTDHFVISHGKILVSINAPRQNQSKNICSLLLDCKEIISWMFYFFLFLMMLIHQKSLARLKDQCKSRAKQGLTGFFFPHKNKLVANNEKLLVARSEVVKT

SEQ ID NO: 794818 - protein, 115 aa, Homo sapiens
GWSQCSELKQSACLRLPECWDYRCEQTHLTSPFFYWYTCLALYQCHTVLITIAFGTGTRQGCPLSPLLFHIVLEVLARAVRQEKEIKSIQIGNEEVKLSLFADAMIVYLENPKDS

SEQ ID NO: 794819 - protein, 136 aa, Homo sapiens
VCPVCETCLLSLVKLAGPTHPKCHPKEFGDKIILEKLPDGAYLTCLFFPGERGASGGRETPLARWSCHCGRTENSDVPASLPFLTSTKGPQPKSTSLGPIQPGLSPQHNHLGDFLSILGKRNFQAVHFYKELNKWV

SEQ ID NO: 794820 - protein, 681 aa, Homo sapiens
AESRGKLRCGRPGWWLSSGLQAEGRRGRGGHVRALPRWVVGVLRRRLLCQTDKREMMANDAKPDVKTVQVLRDTANRLRIHSIRATCASGSGQLTSCCSAAEVVSVLFFHTMKYKQTDPEHPDNDRFILSRGHAAPILYAAWVEVGDISESDLLNLRKLHSDLERHPTPRLPFVDVATGSLGQGLGTACGMAYTGKYLDKASYRVFCLMGDGESSEGSVWEAFAFASHYNLDNLVAVFDVNRLGQSGPAPLEHGADIYQNCCEAFGWNTYLVDGHDVEALCQAFWQASQVKNKPTAIVAKTFKGRGIPNIEDAENWHGKPVPKERADAIVKLIESQIQTNENLIPKSPVEDSPQISITDIKMTSPPAYKVGDKIATQKTYGLALAKLGRANERVIVLSGDTMNSTFSEIFRKEHPERFIECIIAEQNMVSVALGCATRGRTIAFAGAFAAFFTRAFDQLRMGAISQANINLIGSHCGVSTGEDGVSQMALEDLAMFRSIPNCTVFYPSDAISTEHAIYLAANTKGMCFIRTSQPETAVIYTPQENFEIGQAKVVRHGVNDKVTVIGAGVTLHEALEAADHLSQQGISVRVIDPFTIKPLDAATIISSAKATGGRVITVEDHYREGGIGEAVCAAVSREPDILVHQLAVSGVPQRGKTSELLDMFGISTRHIIAAVTLTLMK

SEQ ID NO: 794821 - protein, 103 aa, Homo sapiens
ENATVTNEHGLWKRSGAEDEQCVTRMTISNILFLEVWLAETIFCSAVIGLHYIYSKYNLKCKNHELDLLFLFSLATCKGDFNLTTTENHNQCEEGLGWLQYQS

SEQ ID NO: 794822 - protein, 117 aa, Homo sapiens
MPPANPPVWIPDLHASHHQHPSSLGHLSSVQGSDLPSSFAVATPPQTVLDTQSFPVFLAPCSRLFSPRSLFSHQRSRSHPGPSHLFFCGLGSQDLCHQGLVQLSSAGPSATLRLPTA

SEQ ID NO: 794823 - protein, 1110 aa, Homo sapiens
RPQVSACLWPGVGNCRRQFPSRWRTRRLEVLRGWKSARSYPRPLSVWHLDCAIDPTCVLCMDCFQDSVHKNHRYKMHTSTGGGFCDCGDTEAWKTGPFCVNHEPGRAGTIKENSRCPLNEEVIVQARKIFPSVIKYVVEMTIWEEEKELPPELQIREKNERYYCVLFNDEHHSYDHVIYSLQRALDCELAEAQLHTTAIDKEGRRAVKAGAYAACQEAKEDIKSHSENVSQHPLHVEVLHSEIMAHQKFALRLGSWMNKIMSYSSDFRQIFCQACLREEPDSENPCLISRLMLWDAKLYKGARKILHELIFSSFFMEMEYKKLFAMEFVKYYKQLQKEYISDDHDRSISITALSVQMFTVPTLARHLIEEQNVISVITETLLEVLPEYLDRNNKFNFQGYSQDKLGRVYAVICDLKYILISKPTIWTERLRMQFLEGFRSFLKILTCMQGMEEIRRQVGQHIEVDPDWEAAIAIQMQLKNILLMFQEWCACDEELLLVAYKECHKAVMRCSTSFISSSKTVVQSCGHSLETKSYRVSEDLVSIHLPLSRTLAGLHVRLSRLGAVSRLHEFVSFEDFQVEVLVEYPLRCLVLVAQVVAEMWRRNGLSLISQVFYYQDVKCREEMYDKDIIMLQIGASLMDPNKFLLLVLQRYELAEAFNKTISTKDQDLIKQYNTLIEEMLQVLIYIVGERYVPGVGNVTKEEVTMREIIHLLCIEPMPHSAIAKNLPENENNETGLENVINKVATFKKPGVSGHGVYELKDESLKDFNMYFYHYSKTQHSKAEHMQKKRRKQENKDEALPPPPPPEFCPAFSKVINLLNCDIMMYILRTVFERAIDTDSNLWTEGMLQMAFHILALGLLEEKQQLQKAPEEEVTFDFYHKASRLGSSAMNIQMLLEKLKGIPQLEGQKDMITWILQMFDTVKRLREKSCLIVATTSGSESIKNDEITHDKEKAERKRKAEAARLHRQKIMAQMSALQKNFIETHKLMYDNTSEMPGKEDSIMEEESTPAVSDYSRIALGPKRGPSVTEKEVLTCILCQEEQEVKIENNAMVLSACVQKSTALTQHRGKPIELSGEALDPLFMDPDLAYGTYTGSCGHVMHAVCWQNSSGG

SEQ ID NO: 794824 - protein, 782 aa, Homo sapiens
RPQVSACLWPGVGNCRRQFPSRWRTRRLEVLRGWKSARSYPRPLSVWHLDCAIDPTCVLCMDCFQDSVHKNHRYKMHTSTGGGFCDCGDTEAWKTGPFCVNHEPGRAGTIKENSRCPLNEEGMEEIRRQVGQHIEVDPDWEAAIAIQMQLKNILLMFQEWCACDEELLLVAYKECHKAVMRCSTSFISSSKTVVQSCGHSLETKSYRVSEDLVSIHLPLSRTLAGLHVRLSRLGAVSRLHEFVSFEDFQVEVLVEYPLRCLVLVAQVVAEMWRRNGLSLISQVFYYQDVKCREEMYDKDIIMLQIGASLMDPNKFLLLVLQRYELAEAFNKTISTKDQDLIKQYNTLIEEMLQVLIYIVGERYVPGVGNVTKEEVTMREIIHLLCIEPMPHSAIAKNLPENENNETGLENVINKVATFKKPGVSGHGVYELKDESLKDFNMYFYHYSKTQHSKAEHMQKKRRKQENKDEALPPPPPPEFCPAFSKVINLLNCDIMMYILRTVFERAIDTDSNLWTEGMLQMAFHILALGLLEEKQQLQKAPEEEVTFDFYHKASRLGSSAMNIQMLLEKLKGIPQLEGQKDMITWILQMFDTVKRLREKSCLIVATTSGSESIKNDEITHDKEKAERKRKAEAARLHRQKIMAQMSALQKNFIETHKLMYDNTSEMPGKEDSIMEEESTPAVSDYSRIALGPKRGPSVTEKEVLTCILCQEEQEVKIENNAMVLSACVQKSTALTQHRGKPIELSGEALDPLFMDPDLAYGTYTGSCGHVMHAVCWQNSSGG

SEQ ID NO: 794825 - protein, 67 aa, Homo sapiens
SFLNTQITHDKEKAERKRKAEAARLHRQKIMAQMSALQKNFIETHKLMYDNTSEMPGKEDSIMEEER

SEQ ID NO: 794826 - protein, 71 aa, Homo sapiens
SPLGQLAVLWRCTQLELTRYSFFFIRCHLAGGQKDSLEPGGQQDRGNRKYMTDDVFRPQKGLEEAGDLLFE

SEQ ID NO: 794827 - protein, 133 aa, Homo sapiens
GKGHDQGPASVMHSPLHPGALLQAHHQAAYICSPPALSSQEAPHLSLPEEYGSQGGLLQAFLSTHALPPSLQASKELISRETLPSCPTFPSASSRNCPLTSLCLGLLVTLVHTKTVLPLSATESTQISSASQN

SEQ ID NO: 794828 - protein, 94 aa, Homo sapiens
QQQPEGPTHRSLNWSSGMRWTAGQGEESSSFLTGGLKWGAPAHLKSARTSWRKRSSEHQDIVEEKELRTPGHRGGKGAQNTKSMKLFMNVWAHL

SEQ ID NO: 794829 - protein, 106 aa, Homo sapiens
RSAGKEGWVSGVRGGGGLPPRSRPSAFLFPTSGPHVRRSEPPITLVTNIMGSQWPRCGVFSSWGLCWGFSLSSLPAIPFAGEQLAAFPQPVPFAGPVDPMRCTMEG

SEQ ID NO: 794830 - protein, 162 aa, Homo sapiens
MVVDAWLAECMVGSVGVPSRAGSKLPKRCAPCSHSSTCFQTKHTQIWARLPFFPRVLQISLHKTSHSPGSSSSSEGHKPTKATVRDRSSEASCSATPLCGSKKTRVLERPRTLLVDTSASGRPTQGPREGRCSTGLRSTRGALAFLRTQDLARKQKYQRKTC

SEQ ID NO: 794831 - protein, 293 aa, Homo sapiens
MVGQRVLLLVAFLLSGVLLSEAAKILTISTLGGSHYLLLDRVSQILQEHGHNVTMLHQSGKFLIPDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQVSEPSAFSLGFT

SEQ ID NO: 794832 - protein, 239 aa, Homo sapiens
MLHQSGKFLIPDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQVSEPSAFSLGFT

SEQ ID NO: 794833 - protein, 239 aa, Homo sapiens; identical to SEQ ID NO: 794832

SEQ ID NO: 794834 - protein, 72 aa, Homo sapiens
KQCKGIVDCIVRIPKDQGVLSFWRGNLANVIRYSPTQALNFAFKDKYKQIFLAGVDKHTQFCRYFAGNLASG

SEQ ID NO: 794835 - protein, 367 aa, Homo sapiens
RDSISKTKQINEQKNPQRIIFLFTRFLVSLAPPEEEQGPFLLLFIAASPTPRAEPGMGRKSSVDIWWPQANEASKKGKLGAPHCTCHLSHIFRSLWKVVHSPGVLSNLVSSEVEGPRRVSPAPDTLGMEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEEVVVRVLDERLVRLRDGTRSYFGAFMV

SEQ ID NO: 794836 - protein, 130 aa, Homo sapiens [sequence omitted]

SEQ ID NO: 794837 - protein, 94 aa, Homo sapiens
TGWLQALVLLTSGQALFEVYEYIFKRLGSKLVFPVLSRKLTELVALSAGRHRFPLPPAAAFLSTWKHRGVKSNQTWVRRVWLAFPAGQNFLKLG

SEQ ID NO: 794838 - protein, 76 aa, Homo sapiens
MTLLLHKLEFLQLERNRLMPCFMMPRLGQAGPVQPDVLTAGLAAPETTVTVLACPALGPGPPRPGWRNLAPLQLSK

SEQ ID NO: 794839 - protein, 158 aa, Homo sapiens
MLLLDCNPEVDGLKHLLETGASVNAPPDPCKQSPVHLAAGSGLACFLLWQLQTGADLNQQDVLGEAPLHKAAKVGSLECLSLLVASDAQIDLCNKNGQTAEDLAWSCGFPDCAKFLTTIKCMQTIKASEHPDRNDCVAVLRQKRSLGSVENTSGKRKC

SEQ ID NO: 794840 - protein, 158 aa, Homo sapiens; identical to SEQ ID NO: 794839

SEQ ID NO: 794841 - protein, 157 aa, Homo sapiens
GQGRVLRIACRGYPKWGAVAKAGPEVPTVFIFSRARASLRILTVGVRRVSHLSALPRTLVICLRREMLLLDCNPEVDGLKHLLETGASVNAPPDPCKQSPVHLAAGSGLACFLLWQLQTGADLNQQDVLGEAPLHKAAKVGSLECLSLLVASDAQIE

SEQ ID NO: 794842 - protein, 157 aa, Homo sapiens; identical to SEQ ID NO: 794841

SEQ ID NO: 794843 - protein, 147 aa, Homo sapiens
MTSSLKIWGILLALLCILCRLCVYSNNIYWREFIKLHYLSPSREFKEYKCDVLMREKEALKGKSFHMFIYSLWFKIQRACINEKGSDRYRNAYVWAPGALKVLECHWEKYNNRYTESRSFSYIEFHCGVDGYVDNIEDLRIIEPISN

SEQ ID NO: 794844 - protein, 137 aa, Homo sapiens
GSASAGAQPVASGGQARGPPCSKTPAPSFPGALQIGGGKSASILQEKPPLSPTSPTLPPPPTTITAAAARPAAAAAAAPARPVPPPPPPPPLPGQNHGKRDPRTCAAELKGLQNTGKSGLKRKAPRPPKEENWRSKG

SEQ ID NO: 794845 - protein, 137 aa, Homo sapiens
GAPTPGVQVVQKSSRYVEIEQGLGKPNGALESRCKSVPTILYGRRWNSSRASCLEPEAALAWSARRCPDLAQAAAPPRPLAQPTSVGLPRLGSRKLCPLQHQANKLYLGGADSTFTEPECNRMPEQKGLQRPYPLYR

SEQ ID NO: 794846 - protein, 106 aa, Homo sapiens
PRPPPPPPPPSLPCAVPPHTYYRTPSLSPGGAAPPCIGWGKKKRGGRGPQKFGRRFPPEEKQFKMVWLDCRIGSNEWQVMNLKNCISFLFPHHNFWHKESVLRNPN

SEQ ID NO: 794847 - protein, 1987 aa, Homo sapiens
PKLGEERGVVCRWPFNLERKMSESEGGKDTTPEPSPANGAGPGPEWGLCPGPPAVEGESSGASGLGTPKRRNQHSKHKTVAVASAQRSPRALFCLTLANPLRRSCISIVEWNWPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 794848 - protein, 1998 aa, Homo sapiens
PKLGEERGVVCRWPFNLERKMSESEGGKDTTPEPSPANGAGPGPEWGLCPGPPAVEGESSGASGLGTPKRRNQHSKHKTVAVASAQRSPRALFCLTLANPLRRSCISIVEWNWPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGSMAEEGRAGHRPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 794849 - protein, 1928 aa, Homo sapiens
LQSWGKRGGLCADGPSISKERCRNLKAGKVRESFHPCRPLEQGPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGSMAEEGRAGHRPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 794850 - protein, 2021 aa, Homo sapiens
LQSWGKRGGLCADGPSISKERCRNLKAGKVRESFHPCRPLEQGPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGSMAEEGRAGHRPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKYALYTLTYESRGQCIALHSPLAPKPPTAASHYPVNRCPKVSTAPSSALSDCPPVLPWQALGYWEEEVVMSWWGLEKGLVGASPIQWYLPNSSRGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 794851 - protein, 376 aa, Homo sapiens
PRCPSDGEMADAQNISLDSPGSVGAVAVPVVFALIFLLGTVGNGLVLAVLLQPGPSAWQEPGSTTDLFILNLAVADLCFILCCVPFQATIYTLDAWLFGALVCKAVHLLIYLTMYASSFTLAAVSVDRYLAVRHPLRSRALRTPRNARAAVGLVWLLAALFSAPYLSYYGTVRYGALELCVPAWEDARRRALDVATFAAGYLLPVAVVSLAYGRTLRFLWAAVGPAGAAAAEARRRATGRAGRAMLAVAALYALCWGPHHALILCFWYGRFAFSPATYACRLASHCLAYANSCLNPLVYALASRHFRARFRRLWPCGRRRRHRARRALRRVRPASSGPPGCPGDARPSGRLLAGGGQGPEPREGPVHGGEAARGPE

SEQ ID NO: 794852 - protein, 137 aa, Homo sapiens
QNAGSRVGPMRYGTPGAIGSLALCSGGGDPALKFPITSMDKHGEREARNRVSVIHGQGTPLGSNGKQNFNQVGRRFAFLTLPSPPWEAEALGVGGVGVLQSPLAPAPEGRGTDVTRMRLCPTPSVPGKFGKVKQSVT

SEQ ID NO: 794853 - protein, 96 aa, Homo sapiens
SPPSDVPSLLSGVTSILTSVPSLPFGVPSLLSGVPSPPSGVPSILPGVPSPPSGVPCSLVSQYSLMSQYSLVSPHYSLVSPHCPLVSPQYSLVSPH

SEQ ID NO: 794854 - protein, 132 aa, Homo sapiens
MSQPWLYSQCIISGKPSEEAAGENGSISAALRPLLLVADVPVLGYLCPSSVSSGVCEAKLLGWGLGGVSAAPEAKTKAEAEAEAEATLVRRKLQVEKLVDRDLDLTVILMVPMPSARRPPALATTGSCSPPG

SEQ ID NO: 794855 - protein, 67 aa, Homo sapiens
THYPGEQSDKAQCLGWGCRLYDLLGNVWEWTASPYQAAEQDMRVLRGASWIDTADGSANHRARVTTR

SEQ ID NO: 794856 - protein, 153 aa, Homo sapiens
YSRALACCFWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 794857 - protein, 153 aa, Homo sapiens; identical to SEQ ID NO: 794856

SEQ ID NO: 794858 - protein, 35 aa, Homo sapiens
EDSMKCWDGWMDGWMDGWMDGWTIQSSEFHEMLNG

SEQ ID NO: 794859 - protein, 54 aa, Homo sapiens
MVPRLGAAAGLLCSVVSGLKIDVPAYLIEAIGVVRWSSIYKLGPRGRIQVRVLI

SEQ ID NO: 794860 - protein, 49 aa, Homo sapiens
RGFIAYGSTGCRGSMAASASEEVSGSFQSRRKAKWEQASYRTGAGPRGW

SEQ ID NO: 794861 - protein, 90 aa, Homo sapiens
ILTDMLEKWCADQFMTCVPKLATEIVFAVLRSLIQMMLIYVLEKAESFPDKLLKLFRNISYFLKKMMSGQAAQEEEGNPDEFSDLLGGCD

SEQ ID NO: 794862 - protein, 65 aa, Homo sapiens
MARHKAGNSTAAALDLKRHPGLLGGDIAWLAEEDLTPLVFQGCQDDDRALDRSQRRGHPFPGSPG

SEQ ID NO: 794863 - protein, 105 aa, Homo sapiens
SGCPRAIRRGERTFFFFLLPPLFFPHLPRTEPKFSLGLLGQRDWPGPARACERGAAVAKGNRAGRDHRLPATPQSSGLASAHSAETCGEAAAAASASRLSLELYI

SEQ ID NO: 794864 - protein, 508 aa, Homo sapiens [sequence omitted]

SEQ ID NO: 794865 - protein, 62 aa, Homo sapiens
MNENKDTDSKKSEEYEDDFEKDLEWLINENEKSDASIIEMACEKEEFSKERFDIAIIYYARP

SEQ ID NO: 794866 - protein, 508 aa, Homo sapiens [sequence omitted]

SEQ ID NO: 794867 - protein, 155 aa, Homo sapiens
MAGGGCSGLRSRHFTPAWATKSETPSQNKQTNKQTNKSTLGIKGTSSACKTPHLLPMKSLTSVQPKRPARPFHCAARCTSSRHAFSVVVICACAPRAAGTFLLCASRTVIQDAETSRQLTQNWGVTSAPAACVPEAVRQGAQETHMPPEPHMHTS

SEQ ID NO: 794868 - protein, 101 aa, Homo sapiens
AHSLTPPSSLIIPRTLPTQSFGTVPAVPPPGTFFLQGSTDLAPSSPPTLIFPGGSSLITPHKATVPLPNPQYRPSTLFSHTMHFDSCTLCSSPHQVVTFMK

SEQ ID NO: 794869 - protein, 292 aa, Homo sapiens
MASPLTPNQDPGPQLCSPPHLPCDQLLTSRGLGVSVAGTFLRPSPPAPLCPTTQASPTWVPALQGAPRSVSMIRTLTRTQLAPFLPDIRALEAHSHPSLVHSHRPGTFNIPTFQVRKPRHRELGARPGGLPGGSRGVSDLRRGSGGLSRHRALPSRFSRDRAQGEGTSRPGSIHGPLTLGKGLSQGRPQVTAPEVVGSCGGLWAPSWAGTAWGPRAEGKKRARVDVSVHTQEHATAEPAQRGSGACAGRPAEEQQDPRRERTAFSEAGSRTILSVYIIALFDPGGPTVAFHR

SEQ ID NO: 794870 - protein, 149 aa, Homo sapiens
HQEGNEAAQGGGRRGPTQHPAICIDTAARRISLPPSRGPPLPAGRGRQERKHAAKERKEAQRRPGCPGETLRPDDTASLSRSGDFPDEGFPGGRQGPAHRSSATLLTMPVCYLPMKSHLGRAWWLTPVIPALWEVEACGSSEIRSLRPS

SEQ ID NO: 794871 - protein, 359 aa, Homo sapiens
MAEPFLSEYQHQPQTSNCTGAAAVQEELNPERPPGAEERVPEEDSRWQSRAFPQLGGRPGPEGEGSLESQPPPLQTQACPESSCLREGEKGQNGDDSSAGGDFPPPAEVEPTPEAELLAQPCHDSEASKLGAPAAGGEEEWGQQQRQLGKKKHRRRPSKKKRHWKPYYKLTWEEKKKFDEKQSLRASRIRAEMFAKGQPVAPYNTTQFLMDDHDQEEPDLKTGLYSKRAAAKSDDTSDDDFMEEGGEEDGGSDGMGGDGSEFLQRDFSETYERYHTESLQNMSKQELIKEYLELEKCLSRMEDENNRLRLESKRLGGDDARVRELELELDRLRAENLQLLTENELHRQQERAPLSKFGD

SEQ ID NO: 794872 - protein, 359 aa, Homo sapiens; identical to SEQ ID NO: 794871

SEQ ID NO: 794873 - protein, 355 aa, Homo sapiens
MAEPFLSEYQHQPQTSNCTGAAAVQEELNPERPPGAEERVPEEDSRWQSRAFPQLGGRPGPEGEGSLESQPPPLQTQACPESSCLREGEKGQNGDDSSAGGDFPPPAEVEPTPEAELLAQPCHDSEASKLGAPAAGGEEEWGQQQRQLGKKKHRRRPSKKKRHWKPYYKLTWEEKKKFDEKQSLRASRIRAEMFAKGQPVAPYNTTQFLMDDHDQEEPDLKTGLYSKRAAAKSDDTSDDDFMEEGGEEDGGSDGMGGDGSEFLQRDFSETYERYHTESLQNMSKQELIKEYLELEKCLSRMEDENNRLRLESKRLGGDDARVRELELELDRLRAENLQLLTENEMDGGSEAFSWG

SEQ ID NO: 794874 - protein, 276 aa, Homo sapiens
MAEPFLSEYQHQPQTSNCTGAAAVQEELNPERPPGAEERVPEEDSRWQSRAFPQLGGRPGPEGEGSLESQPPPLQTQACPESSCLREGEKGQNGDDSSAGGDFPPPAEVEPTPEAELLAQPCHDSEASKLGAPAAGGEEEWGQQQRQLGKKKHRRRPSKKKRHWKPYYKLTWEEKKKFDEKQSLRASRIRAEMFAKGQPVAPYNTTQFLMDDHDQEEPDLKTGLYSKRAAAKSDDTSDDDFMEEGGEEDGGSDGMGGDGSEFLQRDFSEHSKRFTL

SEQ ID NO: 794875 - protein, 359 aa, Homo sapiens; identical to SEQ ID NO: 794871

SEQ ID NO: 794876 - protein, 359 aa, Homo sapiens; identical to SEQ ID NO: 794871

SEQ ID NO: 794877 - protein, 341 aa, Homo sapiens
MAEPFLSEYQHQPQTSNCTGAAAVQEELNPERPPGAEERVPEEDSRWQSRAFPQLGGRPGPEGEGSLESQPPPLQTQACPESSCLREGEKGQNGDDSSAGGDFPPPAEVEPTPEAELLAQPCHDSEASKLGAPAAGGEEEWGQQQRQLGKKKHRRRPSKKKRHWKPYYKLTWEEKIAKGQPVAPYNTTQFLMDDHDQEEPDLKTGLYSKRAAAKSDDTSDDDFMEEGGEEDGGSDGMGGDGSEFLQRDFSETYERYHTESLQNMSKQELIKEYLELEKCLSRMEDENNRLRLESKRLGGDDARVRELELELDRLRAENLQLLTENELHRQQERAPLSKFGD

SEQ ID NO: 794878 - protein, 341 aa, Homo sapiens
MAEPFLSEYQHQPQTSNCTGAAAVQEELNPERPPGAEERVPEEDSRWQSRAFPQLGGRPGPEGEGSLESQPPPLQTQACPESSCLREGEKGQNGDDSSAGGDFPPPAEVEPTPEAELLAQPCHDSEASKLGAPAAGGEEEWGQQQRQLGKKKHRRRPSKKKRHWKPYYKLTWEEKKKFDEKQSLRASRIRAEMFAKGQPVAPYNTTQFLMDDHDQEEPDDDDFMEEGGEEDGGSDGMGGDGSEFLQRDFSETYERYHTESLQNMSKQELIKEYLELEKCLSRMEDENNRLRLESKRLGGDDARVRELELELDRLRAENLQLLTENELHRQQERAPLSKFGD

SEQ ID NO: 794879 - protein, 359 aa, Homo sapiens; identical to SEQ ID NO: 794871

SEQ ID NO: 794880 - protein, 311 aa, Homo sapiens
MAEPFLSEYQHQPQTSNCTGAAAVQEELNPERPPGAEERVPEEDSRWQSRAFPQLGGRPGPEGEGSLESQPPPLQTQACPESSCLREGEKGQNGDDSSAGGDFPPPAEVEPTPEAELLAQPCHDSEASKLGAPAAGGEEEWGQQQRQLGKKKHRRRPSKKKRHWKPYYKLTWEEKKKFDEKQSLRASRIRAEMFAKGQPVAPYNTTQFLMDDHDQEEPDLKTGLYSKRAAAKSDDTSDDDFMEEGGEEDGGSDGMGGDGSEFLQRDFSETYERYHTESLQNMSKQELIKEYLELEKWSSGREFSSSSSSSS

SEQ ID NO: 794881 - protein, 71 aa, Homo sapiens
MTQHVGDERSADAHLPWGEPPAGACGRRQEEGTLHRKGPTRVCRGKPGLLSPEDRAETACGCWRGVRSPGG

SEQ ID NO: 794882 - protein, 120 aa, Homo sapiens
MKAGFHNNKNKLCLAPDFFPPRIVKLTKVLRSMTSLCAFVFTKADVLDQKLISYNINQWFCIIANKMQYGRLSFSLTNIQISFQIWHNVSWPGIFEDRCYLAAINMLHQASFKSFVSSLV

SEQ ID NO: 794883 - protein, 108 aa, Homo sapiens
MGDGNVGVRTIDTVAQRQPRTWSFCDLADSAYPNVLGAQLTWPLKPPHGSCVLKASWPSQGPHPATHRMASNPLDGLLSASTPEGKRRLAQRLWISSSLVKPANSSVI

SEQ ID NO: 794884 - protein, 108 aa, Homo sapiens
YILNLRYHLPKTVLDKSWLRPPGILENASDLLRKMCVRNLVQKYCRGITAERKAMMQQKVVTSEIFRGRKDGYTESLNQPFVNSRIDEGDINPKVLQLISHEKIQKPL

SEQ ID NO: 794885 - protein, 66 aa, Homo sapiens
VPLTNDVMQSMLQVGLPFIQDDELCSGMQNTALGVGLRTSRFAAGIQKSYLNSLDFSFLTYKYKQR

SEQ ID NO: 794886 - protein, 238 aa, Homo sapiens
DRLLQQDKASLTRTLQHRIALHVADGLRYLHSAMIIYRDLKPHNVLLFTLYPNAAIIAKIADYGIAQYCCRMGIKTSEGTPGFRAPEVARGNVIYNQQADVYSFGLLLYDILTTGGRIVEGLKFPNEFDELEIQGKLPDPVKEYGCAPWPMVEKLIKQCLKENPQERPTSAQVFDILNSAELVCLTRRILLPKNVIVECMVATHHNSRNASIWLGCGHTDRGQLSFLDLNTEGYTSEV

SEQ ID NO: 794887 - protein, 56 aa, Homo sapiens
QGTGQKPRSYTASIHRPYHIKQIASKEASAGSLIPTTALCMAPKAIWRQPDAVLVC

SEQ ID NO: 794888 - protein, 124 aa, Homo sapiens
MKEAEGERHGFRKSGRPGEAFKSWITKREQQGATERLECEGKRSPGENRRERLKRAGWLGSVGGRRPPCPSSLAPPASSSPSSVACPSGGSRGSQKEPSPTHSQPPLLPESLPTPHPALPPQLP

SEQ ID NO: 794889 - protein, 121 aa, Homo sapiens
MRNHFKFLSKKDKMAAARRRAWREGERAAGSLTRGLQLEPWHWQGAWRRKRRKTVSRQDHPNRSSKLPWTSLPCPHREAAGDRAYLGNTNHGSDTSEMSCRASASTLIQTLSFSELLQAPG

SEQ ID NO: 794890 - protein, 168 aa, Homo sapiens
MPKGWGVRSSTFLPLWLPVKIELHQVQFHSSSQMIFSTLRSELYKLLALCQHAVVPMGKFLGKTKTQPQGQVVIFSEKGKAIIYLSLPRTVPIYTCIFSQSVGCLFILLIISFNFLLFIYFIETDLIMLPRVILDLLASSDPPTFVSQSAGITDVNYHTQSTCRRFSV

SEQ ID NO: 794891 - protein, 168 aa, Homo sapiens; identical to SEQ ID NO: 794890

SEQ ID NO: 794892 - protein, 33 aa, Homo sapiens
MLQRLAQAVPLLQPPCGAGTGLGSSFTNRLFSN

SEQ ID NO: 794893 - protein, 144 aa, Homo sapiens
GTMLGAGQEKSGLQSGAWVHPFQHCPTQGHSKRNRDWMRRVGAVHVEPGTGRLPVGLAGAVEAMVVVAMVWRGRLLSGQYCSVLCGPFPPVVSWELALREEIPTHSVGCVSGVSTPTTALSTACGWGCGIGPSMPWFRPAGAAA

SEQ ID NO: 794894 - protein, 130 aa, Homo sapiens
KAFSQIAHLTQHQRVHTGERPFECIECGKAFSNGSFLAQHQRIHTGEKPYVCNVCGKAFSHRGYLIVHQRIHTGERPYECKECRKAFSQYAHLAQHQRVHTGEKPYECKVCRKAFSQIAYLDQHQRVHTG

SEQ ID NO: 794895 - protein, 83 aa, Homo sapiens
EVYGFHEMSREYKQPTGGHINSMPRRTSKNVVLGRTKRMQKDSELRSSTEQTVSLLPKQMAQQKWRRQGKNTTDKIERRLKDT

SEQ ID NO: 794896 - protein, 113 aa, Homo sapiens
NCWGRYVCTKTYPFYKHKSKKYKWIRDKFLYRRKPTNSQEWVFFLSGGQDVWDTLDFTDQAVPASRTHPQLPQKTTFKAPDQDMGHTGRCSLSFRASFPGILPPGAPGSPGTG

SEQ ID NO: 794897 - protein, 131 aa, Homo sapiens
MNLPSTKVSWAAVTLLLLLLLLPPALLSSGAAAQPLPDCCRQKTCSCRLYELLHGAGNHAAGILTLGKRRSGPPGLQGRLQRLLQASGNHAAGILTMGRRAGAEPAPRPCLGRRCSAPAAASVAPGGQSGI

SEQ ID NO: 794898 - protein, 171 aa, Homo sapiens
MEGGGRYQKQKISGLLGRRDATAAAAAAAARAVVVRGGCTAPARLLSSKDLLLPPLRAAARRGQSRGRHPHAGQAEVRAPGPPGSAAAPPAGQRQPRRGHPDHGPPRRRRASAAPLPRAPLFRPGRRLRRARRTVRDLSRSSGPVLAQASALCPPSVSPQKKGNKDESPFV

SEQ ID NO: 794899 - protein, 120 aa, Homo sapiens
MASSRRGLLLLLLLTAHLGPSEAQHWSHGWYPGGKRALSSAQDPQNALRPPGRALDTAAGSPVQTAHGLPSDALAPLDDSMPWEGRTTAQWSLHRKRHLARTLLTAAREPRPAPPSSNKV

SEQ ID NO: 794900 - protein, 112 aa, Homo sapiens
MASSRRGLLLLLLLTAHLGPSEAQHWSHGWYPGGKRALSSAQDPQNALRPPGSPVQTAHGLPSDALAPLDDSMPWEGRTTAQWSLHRKRHLARTLLTAAREPRPAPPSSNKV

SEQ ID NO: 794901 - protein, 191 aa, Homo sapiens
MATLIYVDKEIGEPGTRVAAKDVLKLESRPSIKALDGISQVLTPRFGKTYDAPSALPKATRKALGTVNRATEKSVKTNGPRKQKQPSFSAKKMTEKTVKTKSSVPASDDAYPEIEKFFPFNLLDFESFDLPEERQIAHLPLSGVPLMILDEEGELEKLFQLGPPSPVKMPSPPWECNLFAVSFKHSVDPGC

SEQ ID NO: 794902 - protein, 436 aa, Homo sapiens
MAPLWACILVAAGILATDTHHPQDSALYHLSKQLLQKYHKEVRPVYNWTKATTVYLDLFVHAILDVDAENQILKTSVWYQEVWNDEFLSWNSSMFDEIREISLPLSAIWAPDIIINEFVDIERYPDLPYVYVNSSGTIENYKPIQVVSACSLETYAFPFDVQNCSLTFKSILHTVEDVDLAFLRSPEDIQHDKKAFLNDSEWELLSVSSTYSILQSSAGGFAQIQFNVVMRRHPLVYVVSLLIPSIFLMLVDLGSFYLPPNCRARIVFKTSVLVGYTVFRVNMSNQVPRSVGSTPLIGHFFTICMAFLVLSLAKSIVLVKFLHDEQRGGQEQPFLCLRGDTDADRPRVEPRAQRAVVTESSLYGEHLAQPGTLKEVWSQLQSISNYLQTQDQTDQQEAEWLVLLSRFDRLLFQSYLFMLGIYTITLCSLWALWGGV

SEQ ID NO: 794903 - protein, 301 aa, Homo sapiens
TRYASVNIKDKCMDQEVWNDEFLSWNSSMFDEIREISLPLSAIWAPDIIINEFVDIERYPDLPYVYVNSSGTIENYKPIQVVSACSLETYAFPFDVQNCSLTFKSILHTVEDVDLAFLRSPEDIQHDKKAFLNDSEWELLSVSSTYSILQSSAGGFAQIQFNGTSSPSAVAFLVLSLAKSIVLVKFLHDEQRGGQEQPFLCLRGDTDADRPRVEPRAQRAVVTESSLYGEHLAQPGTLKEVWSQLQSISNYLQTQDQTDQQEAEWLVLLSRFDRLLFQSYLFMLGIYTITLCSLWALWGGV

SEQ ID NO: 794904 - protein, 713 aa, Homo sapiens
MPSTEPRHCYRRMEEDTDYRIRFSSLCFFNDHVGFHGTIKSSPSDFIVIEIDEQGQLVNKTIDEPIFKISEIQLEPNNFPKKPKLDLQNLSLEDGRNQEVHTLIKYTDGDQNHQSGSEKEDTIVDGTSKCEEKADVLSSFLDEKTHELLNNFACDVREKWLSKTELIGLPPEFSIGRILDKNQRASLHSAIRQKFPFLVTVGKNSEIVVKPNLEYKELCHLVSEEEAFDFFKYLDAKKENSKFTFKPDTNKDHRKAVHHFVNKKFGNLVETKSFSKMNCSAGNPNVVVTVRFREKAHKRGKRPLSECQEGKVIYTAFTLRKENLEMFEAIGFLAIKLGVIPSDFSYAGLKDKKAITYQAMVVRKVTPERLKNIEKEIEKKRMNVFNIRSVDDSLRLGQLKGNHFDIVIRNLKKQINDSANLRERIMEAIENVKKKGFVNYYGPQRFGKGRKVHTDQIGLALLKNEMMKAIKLFLTPEDLDDPVNRAKKYFLQTEDAKGTLSLMPEFKVRERALLEALHRFGMTEEGCIQAWFSLPHSMRIFYVHAYTSKIWNEAVSYRLETYGARVVQGDLVCLDEDIDDENFPNSKIHLVTEEEGSANMYAIHQVVLPVLGYNIQYPKNKVGQWYHDILSRDGLQTCRFKVPTLKLNIPGCYRQILKHPCNLSYQLMEDHDIDVKTKGSHIDETALSLLISFDLDASCYATVCLKEIMKHDV

SEQ ID NO: 794905 - protein, 713 aa, Homo sapiens; identical to SEQ ID NO: 794904

SEQ ID NO: 794906 - protein, 701 aa, Homo sapiens
MEEDTDYRIRFSSLCFFNDHVGFHGTIKSSPSDFIVIEIDEQGQLVNKTIDEPIFKISEIQLEPNNFPKKPKLDLQNLSLEDGRNQEVHTLIKYTDGDQNHQSGSEKEDTIVDGTSKCEEKADVLSSFLDEKTHELLNNFACDVREKWLSKTELIGLPPEFSIGRILDKNQRASLHSAIRQKFPFLVTVGKNSEIVVKPNLEYKELCHLVSEEEAFDFFKYLDAKKENSKFTFKPDTNKDHRKAVHHFVNKKFGNLVETKSFSKMNCSAGNPNVVVTVRFREKAHKRGKRPLSECQEGKVIYTAFTLRKENLEMFEAIGFLAIKLGVIPSDFSYAGLKDKKAITYQAMVVRKVTPERLKNIEKEIEKKRMNVFNIRSVDDSLRLGQLKGNHFDIVIRNLKKQINDSANLRERIMEAIENVKKKGFVNYYGPQRFGKGRKVHTDQIGLALLKNEMMKAIKLFLTPEDLDDPVNRAKKYFLQTEDAKGTLSLMPEFKVRERALLEALHRFGMTEEGCIQAWFSLPHSMRIFYVHAYTSKIWNEAVSYRLETYGARVVQGDLVCLDEDIDDENFPNSKIHLVTEEEGSANMYAIHQVVLPVLGYNIQYPKNKVGQWYHDILSRDGLQTCRFKVPTLKLNIPGCYRQILKHPCNLSYQLMEDHDIDVKTKGSHIDETALSLLISFDLDASCYATVCLKEIMKHDV

SEQ ID NO: 794907 - protein, 701 aa, Homo sapiens; identical to SEQ ID NO: 794906

SEQ ID NO: 794908 - protein, 875 aa, Homo sapiens
TEGFRACAQRCANECLPLNRGRRGRVSCAMVGLYVCVCVCVWGGGVTRLALRIHTLCAQRKVTWTSVVPLDRQSKRREKKQVELLALSGTPLDVLEGNDALVFCEVKSASAGLGSVFLVPSQDPSSANEFLNHGPSKLLPRPLSAAVSVEWEYCTFRLNATWAPLLSSRHCYRRMEEDTDYRIRFSSLCFFNDHVGFHGTIKSSPSDFIVIEIDEQGQLVNKTIDEPIFKISEIQLEPNNFPKKPKLDLQNLSLEDGRNQEVHTLIKYTDGDQNHQSGSEKEDTIVDGTSKCEEKADVLSSFLDEKTHELLNNFACDVREKWLSKTELIGLPPEFSIGRILDKNQRASLHSAIRQKFPFLVTVGKNSEIVVKPNLEYKELCHLVSEEEAFDFFKYLDAKKENSKFTFKPDTNKDHRKAVHHFVNKKFGNLVETKSFSKMNCSAGNPNVVVTVRFREKAHKRGKRPLSECQEGKVIYTAFTLRKENLEMFEAIGFLAIKLGVIPSDFSYAGLKDKKAITYQAMVVRKVTPERLKNIEKEIEKKRMNVFNIRSVDDSLRLGQLKGNHFDIVIRNLKKQINDSANLRERIMEAIENVKKKGFVNYYGPQRFGKGRKVHTDQIGLALLKNEMMKAIKLFLTPEDLDDPVNRAKKYFLQTEDAKGTLSLMPEFKVRERALLEALHRFGMTEEGCIQAWFSLPHSMRIFYVHAYTSKIWNEAVSYRLETYGARVVQGDLVCLDEDIDDENFPNSKIHLVTEEEGSANMYAIHQVVLPVLGYNIQYPKNKVGQWYHDILSRDGLQTCRFKVPTLKLNIPGCYRQILKHPCNLSYQLMEDHDIDVKTKGSHIDETALSLLISFDLDASCYATVCLKEIMKHDV

SEQ ID NO: 794909 - protein, 713 aa, Homo sapiens; identical to SEQ ID NO: 794904

SEQ ID NO: 794910 - protein, 104 aa, Homo sapiens
IPPQPVPTGFKQPLPPSRDTHSAHSPFPSLRMFRLLPYGSPSTCRSQDNRGYGGVTEELMERKRWNSTDGYWTQSLEARRRRPCHIEEPASSSLAAHLIGQFSR

SEQ ID NO: 794911 - protein, 103 aa, Homo sapiens [sequence omitted]

SEQ ID NO: 794912 - protein, 70 aa, Homo sapiens
DEGDYRRRSRPATREPRAGGGGESKKPVGPVGSRVRGAGARGGGLGLARKGAGAGGGGVAAAAAARSGSP

SEQ ID NO: 794913 - protein, 126 aa, Homo sapiens
VYNLLFFGDSLALLPRLECSDVISAHCNLRLLGSSNSPASASQVAGITGMQHHDPLIFVYLVETGFHRFGLAGLKLLTSSDQPTSASQSAGITGMSHLAQPVIYSQMVQENNVYFHIETEIKTQKG

SEQ ID NO: 794914 - protein, 271 aa, Homo sapiens
GPSKKAVVYSIGNMLVLYGHSTQDLPETNARVVGGTEAGRNSWPSQISLQYRSGGSRYHTCGGTLIRQNWVMTAAHCVDYQKTFRVVAGDHNLSQNDGTEQYVSVQKIVVHPYWNSDNVAAGYDIALLRLAQSVTLNSYVQLGVLPQEGAILANNSPCYITGWGKTKTNGQLAQTLQQAYLPSVDYAICSSSSYWGSTVKNTMVCAGGDGVRSGCQGDSGGPLHCLVNGKYSLHGVTSFVSSRGCNVSRKPTVFTQVSAYISWINNVIASN

SEQ ID NO: 794915 - protein, 490 aa, Homo sapiens
QDDDAAQGVISASASNLDDFYPAEEDTKQNSNNTRGNANKTQKDTGVNEKAREKFYEAKLQQQQRELTLQTACPDLQLWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNGKETKNRWKNNCPFSADENYRPLAKTRQQNISMQRQENLRWVSELSYVEEKEQWQEQINQLKKQLDFSVSICQTLMQDQQWMSRLPSRLTLRLLKKMNMMNRSYNVTLKRQQKAKMSHWNEKPLVKMTKITVLVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 794916 - protein, 307 aa, Homo sapiens
QDDDAAQGVISASASNLDDFYPAEEDTKQNSNNTRGNANKTQKDTGVNEKAREKFYEAKLQQQQRELTLQTACPDLQLWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNGKETKNRWKNNCPFSADENYRPLAKTRQQNISMQRQENLRWVSELSYVEEKEQWQEQINQLKKQLDFSVSICQTLMQDQQTLSCLLQLFSRDTGIRSPGYQGDPSR

SEQ ID NO: 794917 - protein, 300 aa, Homo sapiens
QDDDAAQGVISASASNLDDFYPAEEDTKQNSNNTRGNANKTQKDTGVNEKAREKFYEAKLQQQQRELTLQTACPDLQLWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNGKETKNRWKNNCPFSADENYRPLAKTRQQNISMQRQENLRWVSELSYVEEKEQWQEQINQLKKQLDFSVSICQTLMQDQQTLSCLLQTLLTGPYSVMPS

SEQ ID NO: 794918 - protein, 921 aa, Homo sapiens
DFFSMDFKEVVENLVTNDNSPNIPEAIDRLFSDIANINRESMAEITDIQIEEMAVNLWNWALTIGGGWLVNEEQKIRLHYVACKLLSMCEASFASEQSIQRLIMMNMRIGKEWLDAGNFLIADECFQAAVASLEQLYVKLIQRSSPEADLTMEKITVESDHFRVLSYQAESAVAQGDFQRASMCVLQCKDMLMRLPQMTSSLHHLCYNFGVETQKNNKYEESSFWLSQSYDIGKMDKKSTGPEMLAKVLRLLATNYLDWDDTKYYDKALNAVNLANKEHLSSPGLFLKMKILLKGETSNEELLEAVMEILHLDMPLDFCLNIAKLLMDHERESVGFHFLTIIHERFKSSENIGKVLILHTDMLLQRKEELLAKEKIEEIFLAHQTGRQLTAESMNWLHNILWRQAASSFEVQNYTDALQWYYYSLRFYSTDEMDLDFTKLQRNMACCYLNLQQLDKAKEAVAEAERHDPRNVFTQFYIFKIAVIEGNSERALQAIITLENILTDEESEDNDLVAERGSPTMLLSLAAQFALENGQQIVAEKALEYLAQHSEDQEQVLTAVKCLLRFLLPKIAEMPESEDKKKEMDRLLTCLNRAFVKLSQPFGEEALSLESRANEAQWFRKTAWNLAVQCDKDPVMMREFFILSYKMSQFCPSDQVILIARKTCLLMAVAVDLEQGRKASTAFEQTMFLSRALEEIQTCNDIHNFLKQTGTFSNDSCEKLLLLYEFEVRAKLNDPLLESFLESVWELPHLETKTFETIAIIAMEKPAHYPLIALKALKKALLLYKKEEPIDISQYSKCMHNLVNLSVPDGASNVELCPLEEVWGYFEDALSHISRTKDYPEMEILWLMVKSWNTGVLMFSRSKYASAEKWCGLALRFLNHLTSFKESYETQMNMLYSQLVEALSNNKGPVFHEHGYWSKSD

SEQ ID NO: 794919 - protein, 369 aa, Homo sapiens [sequence omitted]

SEQ ID NO: 794920 - protein, 145 aa, Homo sapiens
CGAVSYRRRNGIRGIKESAPDYPRREGWRRNPDLHDVNEPFDSLFLLLTCTPNLCTFTPVPPCSGVNSGNGPTCGVPPQCWVLFHMTDHCRGIIRTILQMRTQGSERSSYLLQNWDLYPGDLTLQQSLSITRHHLPQKKRKASEC

SEQ ID NO: 794921 - protein, 80 aa, Homo sapiens
ELEVFGDNSVLHKICKSLDKEAEIPAWDKWSLKSGKKTEKTRAECISSFLLAFLDKDCIIPVEGQAISSETLYVFSSIYC

SEQ ID NO: 794922 - protein, 129 aa, Homo sapiens
FPQITSTRMFTRFFPLPPRFSKHCFQQRRFQQCMTATSAWAWRRCARGGFRAARHISYSGADSVMGASRFVRRPWRAQGSPSVPASRASVNISFGQRDPAGCWGATVTKADPITPSPSSWFGQQNAETN

SEQ ID NO: 794923 - protein, 530 aa, Homo sapiens [sequence omitted]

SEQ ID NO: 794924 - protein, 530 aa, Homo sapiens [sequence omitted]

SEQ ID NO: 794925 - protein, 526 aa, Homo sapiens
LPVALLPSSVRRQDLLWGFVALLWGPGGCWSTFPGPQQPSKMGKGAARRTVDSQMASVLLDEMQIQHPTASLIAKVATAQDDVTGDGTTSNVLIIGELLKQADLYISEGLHPRIIAEGFEAAKIKALEVLEEVKVTKEMKRKILLDVARTSLQTKVHAELADVLTEVVVDSVLAVRRPGYPIDLFMVEIMEMKHKLGTDTKLIQGLVLDHGARHPDMKKRVEDAFILICNVSLEYEKTEVNSGFFYKTAEEKEKLVKAERKFIEDRVQKIIDLKDKVCAQSNKGFVVINQKGIDPFSLDSLAKHGIVALRRAKRRNMERLSLACGGMAVNSFEDLTVDCLGHAGLVYEYTLGEEKFTFIEECVNPCSVTLLVKGPNKHTLTQVKDAIRDGLRAIKNAIEDGCMVPGAGAIEVAMAEALVTYKNSIKGRARLGVQAFADALLIIPKVLAQNAGYDPQETLVKVQAEHVESKQLVGVDLNTGEPMVAADAGVWDNYCVKKQLLHSCTVIATNILLVDEIMRAGMSSLK

SEQ ID NO: 794926 - protein, 464 aa, Homo sapiens
MQIQHPTASLIAKVATAQDDVTGDGTTSNVLIIGELLKQADLYISEGLHPRIIAEGFEAAKIKALEVLEEVKVTKEMKRKILLDVARTSLQTKVHAELADVLTEVVVDSVLAVRRPGYPIDLFMVEIMEMKHKLGTDTKLIQGLVLDHGARHPDMKKRVEDAFILICNVSLEYEKTEVNSGFFYKTAEEKEKLVKAERKFIEDRVQKIIDLKDKVCAQSNKGFVVINQKGIDPFSLDSLAKHGIVALRRAKRRNMERLSLACGGMAVNSFEDLTVDCLGHAGLVYEYTLGEEKFTFIEECVNPCSVTLLVKGPNKHTLTQVKDAIRDGLRAIKNAIEDGCMVPGAGAIEVAMAEALVTYKNSIKGRARLGVQAFADALLIIPKVLAQNAGYDPQETLVKVQAEHVESKQLVGVDLNTGEPMVAADAGVWDNYCVKKQLLHSCTVIATNILLVDEIMRAGMSSLK

SEQ ID NO: 794927 - protein, 388 aa, Homo sapiens
MKRKILLDVARTSLQTKVHAELADVLTEVVVDSVLAVRRPGYPIDLFMVEIMEMKHKLGTDTKLIQGLVLDHGARHPDMKKRVEDAFILICNVSLEYEKTEVNSGFFYKTAEEKEKLVKAERKFIEDRVQKIIDLKDKVCAQSNKGFVVINQKGIDPFSLDSLAKHGIVALRRAKRRNMERLSLACGGMAVNSFEDLTVDCLGHAGLVYEYTLGEEKFTFIEECVNPCSVTLLVKGPNKHTLTQVKDAIRDGLRAIKNAIEDGCMVPGAGAIEVAMAEALVTYKNSIKGRARLGVQAFADALLIIPKVLAQNAGYDPQETLVKVQAEHVESKQLVGVDLNTGEPMVAADAGVWDNYCVKKQLLHSCTVIATNILLVDEIMRAGMSSLK

SEQ ID NO: 794928 - protein, 106 aa, Homo sapiens
VRRIRRSVPRDVEVMGGRGGVSLCHPGWSAVCVISTHCNLCLLGSSDSPASASRVAGITEFLESLRSPWARSHSESCRIFLLTPAVPVESTDPTGIIKLSARKPQG

SEQ ID NO: 794929 - protein, 102 aa, Homo sapiens
MPANEDAPQPGEHGSACEVSVSFEDVTVDFSREEWQQLDSTQRRLYQDVMLENYSHLLSVGFEVPKPEVIFKLEQGEGPWTLEGEAPHQSCSGISTYFVTST

SEQ ID NO: 794930 - protein, 106 aa, Homo sapiens; identical to SEQ ID NO: 794928

SEQ ID NO: 794931 - protein, 75 aa, Homo sapiens
PPPPPRRAPRPGAGGAQAYRFSLLTTRLLLEDGGGVVSAIQDCLSYPLQCPSLISCLNQNRTVSGKGKHLFSKGQ

SEQ ID NO: 794932 - protein, 47 aa, Homo sapiens
TAYNISPVKAGILRIVHCVAPCPCMMKNSEMHGCFPEGTCQWKPPGS

SEQ ID NO: 794933 - protein, 54 aa, Homo sapiens
AESWAWLAVGFYRVVAALCTGRGGVTDSHVGRSLLRIRCFKLRNNCAGFYFSIL

SEQ ID NO: 794934 - protein, 131 aa, Homo sapiens
MLTLSKVFLSSVSHSSKWWNLRKGTWESLTYSQSARSTGYQNHHTRDMNLPHLASQEAWISFTVNAPPLNHTSTLPPGPGDTAEEAEGCTIGFPTFEVLGLRLASWLLTLQMVYCGTSSCDHVSVCCSDWS

SEQ ID NO: 794935 - protein, 131 aa, Homo sapiens; identical to SEQ ID NO: 794934

SEQ ID NO: 794936 - protein, 77 aa, Homo sapiens
PHLGGVTGFHKRPGRQAPWDVPECVAFMISATPEAGPLRLPGSSLQNPLTNILCHEPGAGPPREHQSPNIICGVLCH

SEQ ID NO: 794937 - protein, 156 aa, Homo sapiens
RHHAWLIFVFLVETGLHHIGQAGLEPPTSGDPPASASKSAGITGVSHRARSDSLVSRRDGLGGSKEKASPGPRKRPGEASLHFPISCGALPGRAPRLPRAPVEEPRGGRGSSAQPAALNRSQHRLPVVRGRETTQRERKGRLPNGLSSHGVLRGVT

SEQ ID NO: 794938 - protein, 91 aa, Homo sapiens
GRGGYSPSPSLTRSQSRFPSSCRRRPVEDTPAGPAVPPRLALASAVLELELVPPSEPFALAVPAAGNDLALSRLAGPCAAAVRMSPSQGPF

SEQ ID NO: 794939 - protein, 105 aa, Homo sapiens
VRYKVFQKRRRVGLNVGQSWEDVSCRTVTFELEFFRQRSTRTRACGGDCAEELSQSLQPVWETDKFVAEMVCRVKWLAGSLERREKEFGNPSSGLSEVGSNSVLR

SEQ ID NO: 794940 - protein, 325 aa, Homo sapiens
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSVGCIMGELLNGSPLFPGKNDIEQLCYVLRILGTPNPQVWPELTELPDYNKISFKEQVPMPLEEVLPDVSPQALDLLGQFLLYPPHQRIAASKALLHQYFFTAPLPAHPSELPIPQRLGGPAPKAHPGPPHIHDFHVDRPLEESLLNPELIRPFILEG

SEQ ID NO: 794941 - protein, 167 aa, Homo sapiens
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATR

SEQ ID NO: 794942 - protein, 275 aa, Homo sapiens
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSVGCIMGELLNGSPLFPGKNDIEQLCYVLRILGTPNPQVWPELTELPDYNKISFKEQVPMPLEEVLPDVSPQALDLLGQFLLYPPHQRIAASKLPCLPIHLSCRFLSV

SEQ ID NO: 794943 - protein, 325 aa, Homo sapiens; identical to SEQ ID NO: 794940

SEQ ID NO: 794944 - protein, 232 aa, Homo sapiens
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRWYRAPELLYGARQYDQGVDLWSVGCIMGELLNGSPLFPGKNDIEQLCYVLRILGTPNPQVWPAGL

SEQ ID NO: 794945 - protein, 243 aa, Homo sapiens
MDQYCILGRIGEGAHGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSSLSCRTTTRSPLRSRCPCPWRRCCLTSLPRHWICWVNSFSTLLTSASQLPRLSSISTSSQLPCLPIHLSCRFLSV

SEQ ID NO: 794946 - protein, 338 aa, Homo sapiens
MDQYCILGRIGEGAHGIVFKAKHVEPRVGWQCLPSILQTGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSVGCIMGELLNGSPLFPGKNDIEQLCYVLRILGTPNPQVWPELTELPDYNKISFKEQVPMPLEEVLPDVSPQALDLLGQFLLYPPHQRIAASKALLHQYFFTAPLPAHPSELPIPQRLGGPAPKAHPGPPHIHDFHVDRPLEESLLNPELIRPFILEG

SEQ ID NO: 794947 - protein, 325 aa, Homo sapiens; identical to SEQ ID NO: 794940

SEQ ID NO: 794948 - protein, 31 aa, Homo sapiens
IWGQSRERRNEERLNCCASCSQLRGISSYSG

SEQ ID NO: 794949 - protein, 135 aa, Homo sapiens
TPNPFCPLSPVPIPSFSKQGSHGPIWDVGLGGTAVESWVGWVWGSLAPSPEQFGKLEEIQPLFLCPLLNTSRLGWLGWEPGSWVLPGTEGGGHWESGLLVPREGLESALGASRRGEGPDKEGFSPGCHAPVWLPW

SEQ ID NO: 794950 - protein, 103 aa, Homo sapiens
SHGHHEHVTVQQRFCLWPVLRPVDGQIWGPLPNSPQPDLDSIQIGFDQHVENGGVECGIQNGGVGQAWWLMPVIPALWESEAGRSRGQEIETILANTVKPHLH

SEQ ID NO: 794951 - protein, 157 aa, Homo sapiens
MDWDDEYSHNSFDLHCLLNSFPGDLEFEQIFSDIDEKIEQNAASIKHCIKEIQSEINKQCPGVQLQTTTDCFEWLTNYNYSTSESSFISHGDLIKFFKTLQDLLKNEQNQEEMTLDLLWDLSCHSSVSFPSTLSGTSFHFLSRTSLHSVEDNSSMDV

SEQ ID NO: 794952 - protein, 102 aa, Homo sapiens
MDWDDEYSHNSFDLHCLLNSFPGDLEFEQIFSDIDEKIEQNAASIKHCIKEIQSEINKQCPGVQLQTTTDCFEWLTNYNYSTSESSFISHGDLIKFFKTLVK

SEQ ID NO: 794953 - protein, 36 aa, Homo sapiens
MFIHVKEQIKVKQQRVGAGCSLSAMSGFFVELGSSF

SEQ ID NO: 794954 - protein, 42 aa, Homo sapiens
MGPCTLKLTSMENSVSGPGSRLLRFTSRCLDEALAINFEKTI

SEQ ID NO: 794955 - protein, 122 aa, Homo sapiens
AVGLLSVLRPLSPSPEERPLACSSPHLAEEPILGILAVLLCHLLILLTHLIQDAAQVHTWGSAHLHIDLTAHLASRGVHLLWKKGMWMCASGPILISHSQAFPHEVTPLPTRTPPLFFLCSI

SEQ ID NO: 794956 - protein, 81 aa, Homo sapiens
TRRLFSNLILIGKHNNQPGPVLLERAVMCRETAGYGWLLASTELLSLLEPLSPQLLKEHISCTSQVAAGAKVTPDSAVWAP

SEQ ID NO: 794957 - protein, 293 aa, Homo sapiens
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 794958 - protein, 541 aa, Homo sapiens
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNCKLFAASKNVRRKAASTLSDTKNMEIINSTIETLAPDSPFDHKKTVSGFQKLEKLDPIAADQQDTVVFKVTEGKLLRDPLSHPGAEQTGIQNKTQMHPLMSQMSGSVTASMATGSATRKGIVVLIDPLAANGTTDMHTSVPRVKGGQRNITDDSRGQPFIKKMHFTIRLTESAITYRDIVVKKEDGFTQIVLSTRSTEKNALNTEVIKEMVNALNSAAADDSKLVLFSAAGSVFCCGLDFGYFVRHLRNDRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNAIVLEECKALVRCNIKLELEQANERECEVLRKIWSSAQGIESMLKYVENKIDEF

SEQ ID NO: 794959 - protein, 188 aa, Homo sapiens
SRNSNMSKIMRSNNWKNWRNEAEVTLGSANDRQAETRVQRAAVDSSRTTLQLEETVDGFQRQKLKDLQKFFCDFVTIEMVFHAKAVEVYSSAFQTLEKYDLERDLLDFRAKMQGVYGHYDTRLLANTSPPPSVLQSLASQSAQSTIWSPGKEGEESEDNSMEEAPVEDLRALGQGPHKRELPTTVRRT

SEQ ID NO: 794960 - protein, 177 aa, Homo sapiens
SRNSNMSKIMRSNNWKNWRNEAEVTLGSANDRQAETRVQRAAVDSSRTTLQLEETVDGFQRQKLKDLQKFFCDFVTIEMVFHAKAVEVYSSAFQTLEKYDLERDLLDFRAKMQGVYGHYDTRLLANTSPPPSVLQSLASQGTLQVQLSRANEDPEHPHANHECSEHHMEPRKRRGGE

SEQ ID NO: 794961 - protein, 126 aa, Homo sapiens
NKHLRLVAAIIITDVAVVLLLLLFRVLRAPYGAQEKKGRRVRTTPWRRPPWRTSGHWGRDPIRENCPQQSEELSWPWILRWALLCALRQATCPLSLSFLICTTGPISLTSQVALGDRCAWHIVGVQ

SEQ ID NO: 794962 - protein, 260 aa, Homo sapiens
AAGHERKLQQELQKICTCSPQQFNRLHVFGKVFEDICNSSLIFGDLLKKVKDEYELYMATLLESQPAAQYEALLAQLKALGQRPVKTADMDLAREELRMLVTATKAALEQNDRLRSELEMEVALLQSAKERSESSEKHIIDENRLTLTEKVEKKRCEILSKWDEIQALEKEIKTTLVHTGISDITENRIKSIEHEAIQLETENMILKKKIKVTENHVKQIIGKISEERQEGLWKFIKEFVKSEETEDNAQVAEQMASGNS

SEQ ID NO: 794963 - protein, 81 aa, Homo sapiens
VWDAESPATPQPEPGEVSGLLERGERPRPRSCVRRDSHGDWVLLLPGRTDAASQDPSTCVMGEEGLGRADQCREPILPGSP

SEQ ID NO: 794964 - protein, 81 aa, Homo sapiens; identical to SEQ ID NO: 794963

SEQ ID NO: 794965 - protein, 143 aa, Homo sapiens
LSLSGTNWLDCGFAGLLPTSPWEKADHASQPGWNLLAVAGVSLPHLPVYLARSFKPPALVYLPPPTLASLRTLPQSTGGHSGQRCVWRALKAPTWEGKMGGFLQDHSCGRAGQGSPQCNRLPDWLQPRSWGDTQGPENSAKFP

SEQ ID NO: 794966 - protein, 36 aa, Homo sapiens
GRHGRVLLCERSEDTMVQGVSPFDIWGQGTMVTVSS

SEQ ID NO: 794967 - protein, 38 aa, Homo sapiens
VDTAVYYCARDSLTVEMATIPYNTTGAREPWSPSPQVS

SEQ ID NO: 794968 - protein, 103 aa, Homo sapiens
VQYLMEVFGCLFLWGVPKPMSLGIFFQILSALSLSLLSLSFIHTLSHSEMASLQLGAASNSGSGHTHKVPRVANLSSSSVPVQDDVTKHLPSGRCFQRIFIDI

SEQ ID NO: 794969 - protein, 117 aa, Homo sapiens
EDQTRQRNILFHMNCGFDPQTARRNLLGQAAAALSCWSGDLESEKTHRLLCPFSSICTRLSLGPSPLHGEEGHGQGKLSFIQCGEERLSRETDLPQARLTYNAPPYRNGTPSTQSSL

SEQ ID NO: 794970 - protein, 99 aa, Homo sapiens
EDQTRQRNILFHMNCGFDPQTARRNLLGQAAAALSCWSGDLESEKTHRLLCPFSSICTRLSLGPSPLHGEEGHGQGKLSFIQCGEERCPRAGQLPNCDL

SEQ ID NO: 794971 - protein, 113 aa, Homo sapiens
ACRPLELDDQDWRELAGNHQGSQVSSSRNSETTTSQPSIISQRTQAPQPPSDSLFILPSFLFHSCVSGPLLMSHSTTAPTIQGATDLTATRAPTPWSLPVPLSCFGVQARSPS

SEQ ID NO: 794972 - protein, 116 aa, Homo sapiens
MCHPEASRPFSPWYPPPRSCLPKPSSCCCSHNKCHHQGPSSCQCRLSRAGDWGTCSHHLSNSGGSQASQGSDDDRNEKWDDSSTLVDELRTPGRGMYLVFDGSVDLHYHCSAKCKS

SEQ ID NO: 794973 - protein, 116 aa, Homo sapiens; identical to SEQ ID NO: 794972

SEQ ID NO: 794974 - protein, 68 aa, Homo sapiens
MSTKQLLCRKIPDPLRMISLTVPDSPFYKEVTYLLISTPLSIPNNTILTPLLRVKRLETFNLFEPTFP

SEQ ID NO: 794975 - protein, 116 aa, Homo sapiens
DSDSNRGSVILDSGHLSTASSSDDLKGEEGSFRGSVLQRAAKFGSLAKQNSQMIVKRFSFSQRSRDESASETSTPSEHSAAPSPQVEVRTLEGQLVQHPGPGIPRPGHRSRAPELV

SEQ ID NO: 794976 - protein, 111 aa, Homo sapiens
LPRQMNSSSEHWECTCLSDVVMGHMVGSEGDSGPVGQSMWEDCHRDSQRVHSALNRAKDCKGQELGLTCKVALHKALFRECDSLKLFLAASVLNLTGRDPPKHDPDGKKYF

SEQ ID NO: 794977 - protein, 1321 aa, Homo sapiens [sequence omitted]

SEQ ID NO: 794978 - protein, 387 aa, Homo sapiens
MENKLPMETLVEECGENRERKCKLKDQSDKEEGTRDISSPKRLRDRQALFPAKVTNVSLLEKFERSESGGKIMTPESLSYPSCLKHDSEMKPQTSPACQDHNKAGQMKSLATREQNQKNAAYNLGVAEAIRNHKNEKPEFYISFLFDKRPLSPALNALKQEEYSRSLLKQMDNRQENEIKQRQYRELMDRLEQVQLTEELAAQRAKFLKDKMEETQCYKRALDAQIKNKPSRLPPFEPDSSEPIFGKNEGELMVEKQKREQNYMKHQLEAAANHKRKAILHQLVDQRRDLQMLQRTQREHLADRTAELERVNRVNQCLQEDWERSAAMKKQRDLEDKAFERASDKLFLLDQCEKYRRCKQCQRRTSNVGESNLWPLNKFLPGSRLLV

SEQ ID NO: 794979 - protein, 1469 aa, Homo sapiens
MDVDAEREKITQEIKELERILDPGSSGSHVEISESSLESDSEADSLPSEDLDPADPPISEEERWGEASNDEDDPKDKTLPEDPETCLQLNMVYQEVIQEKLAEANLLLAQNREQQEELMRDLAGSKGTKVKDGKSLPPSTYMGHFMKPYFKDKVTGVGPPANEDTREKAAQGIKAFEELLVTKWKNWEKALLRKSVVSDRLQRLLQPKLLKLEYLHQKQSKVSSELERQALEKQGREAEKEIQDINQLPEEALLGNRLDSHDWEKISNINFEGSRSAEEIRKFWQNSEHPSINKQEWSREEEERLQAIAAAHGHLEWQKIAEELGTSRSAFQCLQKFQQHNKALKRKEWTEEEDRMLTQLVQEMRVGSHIPYRRIVYYMEGRDSMQLIYRWTKSLDPGLKKGYWAPEEDAKLLQAVAKYGEQDWFKIREEVPGRSDAQCRDRYLRRLHFSLKKGRWNLKEEEQLIELIEKYGVGHWAKIASELPHRSGSQCLSKWKIMMGKKQGLRRRRRRARHSVRWSSTSSSGSSSGSSGGSSSSSSSSSEEDEPEQAQAGEGDRALLSPQYMVPDMDLWVPARQSTSQPWRGGAGAWLGGPAASLSPPKGSSASQGGSKEASTTAAAPGEETSPVQVPARAHGPVPRSAQASHSADTRPAGAEKQALEGGRRLLTVPVETVLRVLRANTAARSCTQKEQLRQPPLPTSSPGVSSGDSVARSHVQWLRHRATQSGQRRWRHALHRRLLNRRLLLAVTPWVGDVVVPCTQASQRPAVVQTQADGLREQLQQARLASTPVFTLFTQLFQIDTAGCLEVVRERKALPPRLPQAGARDPPVHLLQASSSAQSTPGHLFPNVPAQEASKSASHKGSRRLASSRVERTLPQASLLASTGPRPKPKTVSELLQEKRLQEARAREATRGPVVLPSQLLVSSSVILQPPLPHTPHGRPAPGPTVLNVPLSGPGAPAAAKPGTSGSWQEAGTSAKDKRLSTMQALPLAPVFSEAEGTAPAASQAPALGPGQISVSCPESGLGQSQAPAASRKQGLPEAPPFLPAAPSPTPLPVQPLSLTHIGGPHVATSVPLPVTWVLTAQGLLPVPVPAVVSLPRPAGTPGPAGLLATLLPPLTETRAAQGPRAPALSSSWQPPANMNREPEPSCRTDTPAPPTHALSQSPAEADGSVAFVPGEAQVAREIPEPRTSSHADPPEAEPPWSGRLPAFGGVIPATEPRGTPGSPSGTQEPRGPLGLEKLPLRQPGPEKGALDLEKPPLPQPGPEKGALDLGLLSQEGEAATQQWLGGQRGVRVPLLGSRLPYQPPALCSLRALSGLLLHKKALEHKATSLVVGGEAERPAGALQASLGLVRGQLQDNPAYLLLRARFLAAFTLPALLATLAPQGVRTTLSVPSRVGSESEDEDLLSELELADRDGQPGCTTATCPIQGAPDSGKCSASSCLDTSNDPDDLDVLRTRHARHTRKRRRLV

SEQ ID NO: 794980 - protein, 171 aa, Homo sapiens [sequence omitted]

SEQ ID NO: 794981 - protein, 72 aa, Homo sapiens
ANGARGWMLWFCSSWAGPQSASSRESHAKDGGGRFSLLLGVLGSRVCANDPDDLDVLRTRHARHTRKRRRLV

SEQ ID NO: 794982 - protein, 1021 aa, Homo sapiens
SPGEQQACPGEESLDEGISMGFGFAGHWAKIASELPHRSGSQCLSKWKIMMGKKQGLRRRRRRARHSVRWSSTSSSGSSSGSSGGSSSSSSSSSEEDEPEQAQAGEGDRALLSPQYMVPDMDLWVPARQSTSQPWRGGAGAWLGGPAASLSPPKGSSASQGGSKEASTTAAAPGEETSPVQVPARAHGPVPRSAQASHSADTRPAGAEKQALEGGRRLLTVPVETVLRVLRANTAARSCTQKEQLRQPPLPTSSPGVSSGDSVARSHVQWLRHRATQSGQRRWRHALHRRLLNRRLLLAVTPWVGDVVVPCTQASQRPAVVQTQADGLREQLQQARLASTPVFTLFTQLFQIDTAGCLEVVRERKALPPRLPQAGARDPPVHLLQASSSAQSTPGHLFPNVPAQEASKSASHKGSRRLASSRVERTLPQASLLASTGPRPKPKTVSELLQEKRLQEARAREATRGPVVLPSQLLVSSSVILQPPLPHTPHGRPAPGPTVLNVPLSGPGAPAAAKPGTSGSWQEAGTSAKDKRLSTMQALPLAPVFSEAEGTAPAASQAPALGPGQISVSCPESGLGQSQAPAASRKQGLPEAPPFLPAAPSPTPLPVQPLSLTHIGGPHVATSVPLPVTWVLTAQGLLPVPVPAVVSLPRPAGTPGPAGLLATLLPPLTETRAAQGPRAPALSSSWQPPANMNREPEPSCRTDTPAPPTHALSQSPAEADGSVAFVPGEAQVAREIPEPRTSSHADPPEAEPPWSGRLPAFGGVIPATEPRGTPGSPSGTQEPRGPLGLEKLPLRQPGPEKGALDLEKPPLPQPGPEKGALDLGLLSQEGEAATQQWLGGQRGVRVPLLGSRLPYQPPALCSLRALSGLLLHKKALEHKATSLVVGGEAERPAGALQASLGLVRGQLQDNPAYLLLRARFLAAFTLPALLATLAPQGVRTTLSVPSRVGSESEDEDLLSELELADRDGQPGCTTATCPIQGAPDSGKCSASSCLDTSNDPDDLDVLRTRHARHTRKRRRLV

SEQ ID NO: 794983 - protein, 702 aa, Homo sapiens
PPVPAADGLREQLQQARLASTPVFTLFTQLFQIDTAGCLEVVRERKALPPRLPQAGARDPPVHLLQASSSAQSTPGHLFPNVPAQEASKSASHKGSRRLASSRVERTLPQASLLASTGPRPKPKTVSELLQEKRLQEARAREATRGPVVLPSQLLVSSSVILQPPLPHTPHGRPAPGPTVLNVPLSGPGAPAAAKPGTSGSWQEAGTSAKDKRLSTMQALPLAPVFSEAEGTAPAASQAPALGPGQISVSCPESGLGQSQAPAASRKQGLPEAPPFLPAAPSPTPLPVQPLSLTHIGGPHVATSVPLPVTWVLTAQGLLPVPVPAVVSLPRPAGTPGPAGLLATLLPPLTETRAAQGPRAPALSSSWQPPANMNREPEPSCRTDTPAPPTHALSQSPAEADGSVAFVPGEAQVAREIPEPRTSSHADPPEAEPPWSGRLPAFGGVIPATEPRGTPGSPSGTQEPRGPLGLEKLPLRQPGPEKGALDLEKPPLPQPGPEKGALDLGLLSQEGEAATQQWLGGQRGVRVPLLGSRLPYQPPALCSLRALSGLLLHKKALEHKATSLVVGGEAERPAGALQASLGLVRGQLQDNPAYLLLRARFLAAFTLPALLATLAPQGVRTTLSVPSRVGSESEDEDLLSELELADRDGQPGCTTATCPIQGAPDSGKCSASSCLDTSNDPDDLDVLRTRHARHTRKRRRLV

SEQ ID NO: 794984 - protein, 691 aa, Homo sapiens
LTKSSYRPGMVAHACNPQLFQIDTAGCLEVVRERKALPPRLPQAGARDPPVHLLQASSSAQSTPGHLFPNVPAQEASKSASHKGSRRLASSRVERTLPQASLLASTGPRPKPKTVSELLQEKRLQEARAREATRGPVVLPSQLLVSSSVILQPPLPHTPHGRPAPGPTVLNVPLSGPGAPAAAKPGTSGSWQEAGTSAKDKRLSTMQALPLAPVFSEAEGTAPAASQAPALGPGQISVSCPESGLGQSQAPAASRKQGLPEAPPFLPAAPSPTPLPVQPLSLTHIGGPHVATSVPLPVTWVLTAQGLLPVPVPAVVSLPRPAGTPGPAGLLATLLPPLTETRAAQGPRAPALSSSWQPPANMNREPEPSCRTDTPAPPTHALSQSPAEADGSVAFVPGEAQVAREIPEPRTSSHADPPEAEPPWSGRLPAFGGVIPATEPRGTPGSPSGTQEPRGPLGLEKLPLRQPGPEKGALDLEKPPLPQPGPEKGALDLGLLSQEGEAATQQWLGGQRGVRVPLLGSRLPYQPPALCSLRALSGLLLHKKALEHKATSLVVGGEAERPAGALQASLGLVRGQLQDNPAYLLLRARFLAAFTLPALLATLAPQGVRTTLSVPSRVGSESEDEDLLSELELADRDGQPGCTTATCPIQGAPDSGKCSASSCLDTSNDPDDLDVLRTRHARHTRKRRRLV

SEQ ID NO: 794985 - protein, 1185 aa, Homo sapiens
MDVDAEREKITQEIKELERILDPGSSGSHVEISESSLESDSEADSLPSEDLDPADPPISEEERWGEASNDEDDPKDKTLPEDPETCLQLNMVYQEVIQEKLAEANLLLAQNREQQEELMRDLAGSKGTKVKDGKSLPPSTYMGHFMKPYFKDKVTGVGPPANEDTREKAAQGIKAFEELLVTKWKNWEKALLRKSVVSDRLQRLLQPKLLKLEYLHQKQSKVSSELERQALEKQGREAEKEIQDINQLPEEALLGNRLDSHDWEKISNINFEGSRSAEEIRKFWQNSEHPSINKQEWSREEEERLQAIAAAHGHLEWQKIAEELGTSRSAFQCLQKFQQHNKALKRKEWTEEEDRMLTQLVQEMRVGSHIPYRRIVYYMEGRDSMQLIYRWTKSLDPGLKKGYWAPEEDAKLLQAVAKYGEQDWFKIREEVPGRSDAQCRDRYLRRLHFSLKKGRWNLKEEEQLIELIEKYGVGHWAKIASELPHRSGSQCLSKWKIMMGKKQGLRRRRRRARHSVRWSSTSSSGSSSGSSGGSSSSSSSSSEEDEPEQAQAGEGDRALLSPQYMVPDMDLWVPARQSTSQPWRGGAGAWLGGPAASLSPPKGSSASQGGSKEASTTAAAPGEETSPVQVPARAHGPVPRSAQASHSADTRPAGAEKQALEGGRRLLTVPVETVLRVLRANTAARSCTQKEQLRQPPLPTSSPGVSSGDSVARSHVQWLRHRATQSGQRRWRHALHRRLLNRRLLLAVTPWVGDVVVPCTQASQRPAVVQTQADGLREQLQQARLASTPVFTLFTQLFQIDTAGCLEVVRERKALPPRLPQAGARDPPVHLLQASSSAQSTPGHLFPNVPAQEASKSASHKGSRRLASSRVERTLPQASLLASTGPRPKPKTVSELLQEKRLQEARAREATRGPVVLPSQLLVSSSVILQPPLPHTPHGRPAPGPTVLNVPLSGPGAPAAAKPGTSGSWQEAGTSAKDKRLSTMQALPLAPVFSEAEGTAPAASQAPALGPGQISVSCPESGLGQSQAPAASRKQGLPEAPPFLPAAPSPTPLPVQPLSLTHIGGPHVATSVPLPVTWVLTAQGLLPVPVPAVVSLPRPAGTPGPAGLLATLLPPLTGPGPAVPGGRGGHTAVAGGPAGGACASSGQQTALSAPSPVQPASSVRSPTPQEGPGAQGHLPGGGGRG

SEQ ID NO: 794986 - protein, 74 aa, Homo sapiens
RRARHLTAGEEDKEKKRPFFSSDEQYPLSYRTIRAMPGGLLVNPILYGKYRKNIEPGTKLLQFITPSHLPVCTT

SEQ ID NO: 794987 - protein, 121 aa, Homo sapiens
MTTNQATLGPALHLDCNLQGAAEEEMLKHLQELGYFHSGPETRSCSHHRGEEVRSSCLGRPPLDGAAAAGPAENPRTGGQTGVSEAAPERTGGKVFVPFFVFLTSIHSVALMTSVSQELGI

SEQ ID NO: 794988 - protein, 104 aa, Homo sapiens
QRGEAERLQGTLGASQGGLSYPRRSQGCHRQALKSQGLEHVVGVSHGRPPHAKTGRQGGMGQPKGLKESLRQAEGRSSGTAGDAGSLPRDDSPITEVPRGVLGR

SEQ ID NO: 794989 - protein, 453 aa, Homo sapiens
MKIFKCYFKHTLQQKVFILFLTLWLLSLLKLLNVRRLFPQKDIYLVEYSLSTSPFVRNRYTHVKDEVRYEVNCSGIYEQEPLEIGKSLEIRRRDIIDLEDDDVVAMTSDCDIYQTLRGYAQKLVSKEEKSFPIAYSLVVHKDAIMVERLIHAIYNQHNIYCIHYDRKAPDTFKVAMNNLAKCFSNIFIASKLEAVEYAHISRLQADLNCLSDLLKSSIQWKYVINLCGQDFPLKSNFELVSELKKLNGANMLETVKPPNSKLERFTYHHELRRVPYEYVKLPIRTNISKEAPPHNIQIFVGSAYFVLSQAFVKYIFNNSIVQDFFAWSKDTYSPDEHFWATLIRVPGIPGEISRSAQDVSDLQSKTRLVKWNYYEGFFYPSCTGSHLRSVCIYGAAELRWLIKDGHWFANKFDSKVDPILIKCLAEKLEEQQRDWITLPSEKLFMDRNLTTTS

SEQ ID NO: 794990 - protein, 81 aa, Homo sapiens
EASKRGSHVQRGISEGLSGVEKRGGLLFFHLTLKRHAGSTESDTSEPVSTVWFGLDFHWYSGVLDKSLDLAFVICEVDRFQ

SEQ ID NO: 794991 - protein, 104 aa, Homo sapiens
GGLFRVEASKENVREITGKHPTISPRLSPHPHPIQMAGPGHLHGSHSLRLRAALGMGITESGPIRSSATLGPNRSTPPHLTPSPALRTFFRTLFAFDPRLAPYA

SEQ ID NO: 794992 - protein, 133 aa, Homo sapiens
YPHPQDSAGVDPTLAAHLTGPWISSRTRCTQKDAHILASAPASAHPESCLAPMSTMQPPGLGKRGVRDGLDTQKRSQDLLGLYPGSACLSVPACKVGSMGTHVWAGHSAHTCEPSTLGGQREDPLSSGDRVSL

SEQ ID NO: 794993 - protein, 124 aa, Homo sapiens
MLALYSVIRVRGGGSNGPPPPLWSPFSPLMVTRPPLSSLSYPLCCACSPRAQEYQATGSGPLPSSQAGWVVGGGDFRCGFGRMAKGDCPPFSYRINILLALPSAWSDEISKARSHLGFHPIPLS

SEQ ID NO: 794994 - protein, 63 aa, Homo sapiens
MACLAESAKSSALRLQRRGSALFRALALSRVGQLRARGHLQRKQPSVRPRRPGRKGGGIMELK

SEQ ID NO: 794995 - protein, 41 aa, Homo sapiens
RVDTAVYYCARASPYYYDSSGYYRRLDYWGQGTLVTVSSGS

SEQ ID NO: 794996 - protein, 40 aa, Homo sapiens
AGSTRPCITVREFRGSSRGDLENACDYWGQGTLVTVSSGS

SEQ ID NO: 794997 - protein, 33 aa, Homo sapiens
PGRHGRVLLCESSEATLSGILLRYYYMDVWGKG

SEQ ID NO: 794998 - protein, 170 aa, Homo sapiens
MAPEVIRQDFQAGEVAFRRTGYLRGRSVLTQTKHSLAGNGRHPVALRTRLGSLALGAVPTWTKLWAQSTTWQTRNHTRTGHAYPRFTRPSFPSCNRNGKRRKLRLGKQKRWCVDTSSPKAGKAALETGGATWPRPRRVRMRPARTLRHSIRELGAPAISLGTASSSRPPF

SEQ ID NO: 794999 - protein, 109 aa, Homo sapiens
MAPEVIRQDFQAGEVAFRRTGYLRGRSVLTQTKHSLAGNGRHPVALRTRLGSLALGAVPTWTKLWAQSTTWQTRNHTRTGHAYPRFTRPSFPSCNRNGKRRKLRLGLPY

SEQ ID NO: 795000 - protein, 789 aa, Homo sapiens
DDPNSSDESNGNPHANSESDNNSSSRGDASYNSDESKDNGNGSDSKGAEDDDSDSTSDTNNSDSNGNGNNGNDDNDKSNSGKGKSDSSDSDSSDSSNSSDSSDSSDSDSSDSNSSSDSDSSDSDSSDSSDSDSSDSSNSSDSSDSSDSSDSSDSSDSSDSKSDSSKSESDSSDSDSKSDSSDSNSSDSSDNSDSSDSSNSSNSSDSSDSSDSSDSSSSSDSSNSSDSSDSSDSSNSSESSDSSDSSDSDSSDSSDSSNSNSSDSDSSNSSDSSDSSNSSDSSDSSDSSNSSDSSDSSDSSNSSDSSDSSDSSDSSDSSNSSDSNDSSNSSDSSDSSNSSDSSNSSDSSDSSDSSDSDSSNSSDSSNSSDSSDSSNSSDSSDSSDSSDGSDSDSSNRSDSSNSSDSSDSSDSSNSSDSSDSSDSNESSNSSDSSDSSNSSDSDSSDSSNSSDSSDSSNSSDSSESSNSSDNSNSSDSSNSSDSSDSSDSSNSSDSSNSSDSSNSSDSSDSNSSDSSDSSNSSDSSDSSDSSDSSDSSDSSNSSDSSDSSDSSDSSNSSDSSNSSDSSDSSDSSDSSDSSDSSDSSDSSNSSDSSDSSDSSDSSDSSDSSDSSDSSESSDSSDSSDSSNSSDSSDSSESSDSSDSSDSSDSSDSSDSSDSSDSSDSSNSSDSSDSSDSSDSSDSSDSSDSSDSSDSSDSSDSSDSSDSSDSSDSSDSSDSNESSDSSDSSDSSDSSNSSDSSDSSDSSDSTSHSNDESDSQSKCGNGNNNGSDSDSDCEGSDSNYSTSDDY

SEQ ID NO: 795001 - protein, 74 aa, Homo sapiens
IRGRVDDARRPCIACQKTTEGQMGKKKREVAGGDNLNSTGTPAYQSLHRVLPWSKHDIRVLAASSSGPSSVCLC

SEQ ID NO: 795002 - protein, 79 aa, Homo sapiens
AAPASSARAAALTRAPPTLKPPSSGKKVCDMNEGIIKGTWNQSFWSTANKVQRPNSNHRMNLEVDPLTPVEPSDDCSPG

SEQ ID NO: 795003 - protein, 497 aa, Homo sapiens
MTLGSCCCEIMSSESSPAALSEADADIDVVGGGSGGGELPARSGPRAPRDVLPHGHEPPAEEAEADLAEDEEESGGCSDGEPRALASRGAAAAAGSPGPGAAAARGAAGPGPGPPSGGAATRSPLVKPPYSYIALITMAILQSPKKRLTLSEICEFISGRFPYYREKFPAWQNSIRHNLSLNDCFVKIPREPGNPGKGNYWTLDPESADMFDNGSFLRRRKRFKRQPLPPPHPHPHPHPELLLRGGAAAAGDPGAFLPGFAAYGAYGYGYGLALPAYGAPPPGPAPHPHPHPHPHAFAFAAAAAAAPCQLSVPPGRAAAPPPGPPTASVFAGAGSAPAPAPASGSGPGPGPAGLPAFLGAELGCAKAFYPASLSPPAAGTAAGLPTALLRQGLKTDAGGGAGGGGAGAGQRPSFSIDHIMGHGGGGAAPPGAGEGSPGPPFAAAAGPGGQAQVLAMLTAPALAPVAGHIRLSHPGDALLSSGSRFASKVAGLSGCHF

SEQ ID NO: 795004 - protein, 144 aa, Homo sapiens
PADADGDLEIPGVTASPAAQPLPGVPAVPAELRESIYEVSRPWAGTRDTALQAPRTESRRLLGLSGLYRSGRQARGYAKKSQAKILYSLRNKSRGVGASFFSLPLRLSGNTFRERCLARLHGSRQKHQQRVSLSAFPLSLLPQR

SEQ ID NO: 795005 - protein, 119 aa, Homo sapiens
MSRSKTLIHTSGKPGSRDGEKSKAWSHLDGHPGPSASTSQEEAGTFGRQWREGNRRKRAGAPSSLITGSQGPAVFQGEKSVGLGQISCTVLTFQRLNSLPISRNLIFDVSLNNFKKNKS

SEQ ID NO: 795006 - protein, 216 aa, Homo sapiens
MAVARVDAALPPGEGSVVNWSGQGLQKLGPNLPCEADIHTLILDKNQIIKLENLEKCKRLIQLSVANNRLVRMMGVAKLTLLRVLNLPHNSIGCVEGLKELVHLEWLNLAGNNLKAMEQINSCTALQHLDLSDNNISQIGDLSKLVSLKTLLLHGNIITSLRMAPAYLPRSLAILSLAENEIRDLNEISFLASLTELEQLSIMNNPCVMATPSIPG

SEQ ID NO: 795007 - protein, 69 aa, Homo sapiens
REVERTLGLQPSSCTPWFPRGTHAHVSWRPARGQHHGDDQQLIPPKGPPTGEWIPQQGCMHATEHTTYW

SEQ ID NO: 795008 - protein, 78 aa, Homo sapiens
RRGRRRKKKEEEEEKKVGRSTVPDFKTYCHRCISQDNVVFAEDREIHQWNRIKNPGIHPHKYSQLIFKHSMKDILFNK

SEQ ID NO: 795009 - protein, 219 aa, Homo sapiens
MASAGDTQAGPRDAADQNFDYMFKLLLIGNSSVGKTSFLFRYADDSFTPAFVSTVGIDFKVKTVYRHDKRIKLQIWDTAGQERYRTITTAYYRGAMGFLLMYDIANQESFAAVQDWATQIKTYSWDNAQVILVGNKCDLEDERVVPAEDGRRLADDLGFEFFEASAKENINVKQVFERLVDVICEKMNESLEPSSSSGSNGKGPAVGDAPAPQPSSCSC

SEQ ID NO: 795010 - protein, 184 aa, Homo sapiens [sequence omitted]

SEQ ID NO: 795011 - protein, 184 aa, Homo sapiens [sequence omitted]

SEQ ID NO: 795012 - protein, 184 aa, Homo sapiens [sequence omitted]

SEQ ID NO: 795013 - protein, 72 aa, Homo sapiens
WKVQRSIHRKKNSQPPEANQLKPRNPSHPNAPRGCCLLSGSDEPRGSGKSEDAICMVVNYRGDEARWVWGCS

SEQ ID NO: 795014 - protein, 242 aa, Homo sapiens
MSNPRSLEEEKYDMSGARLALILCVTKAREGSEEDLDALEHMFRQLRFESTMKRDPTAEQFQEELEKFQQAIDSREDPVSCAFVVLMAHGREGFLKGEDGEMVKLENLFEALNNKNCQALRAKPKVYIIQACRGEQRDPGETVGGDEIVMVIKDSPQTIPTYTDALHVYSTVEGYIAYRHDQKGSCFIQTLVDVFTKRKGHILELLTEVTRRMAEAELVQEGKARKTNPEIQSTLRKRLYLQ

SEQ ID NO: 795015 - protein, 133 aa, Homo sapiens
EIRKHHEKRPHCRGIGVPTPGLFGGKVLGWKCRLWGPSCVWFFLSLQQFQEELEKFQQAIDSREDPVSCAFVVLMAHGREGFLKGEDGEMVKLENLFEALNNKNCQALRAKPKVYIIQACRGGGDRSKSTESV

SEQ ID NO: 795016 - protein, 126 aa, Homo sapiens [sequence omitted]

SEQ ID NO: 795017 - protein, 105 aa, Homo sapiens
SHGLALGFLFLDPILLPQVWFLDCNTCHTNDILRYRLLYSNEVTAFLQSLFEENRLLSPCRHCQLRVCDTKEGKAAEGWTIINIPSITLCPSVKSNNEIKCIYIV

SEQ ID NO: 795018 - protein, 119 aa, Homo sapiens
MESQLLPGSICADAQQTYISSPPSGPNPRLLLTHHCQPDVMYTQTSHAHADFPSQLRLHLPQHSSKQLQACGRMARWSKVLDTSFHFPRQLQTSSNLGQHPGAACDPTFVSLPNVRSAS

SEQ ID NO: 795019 - protein, 1044 aa, Homo sapiens
MPAAGSNEPDGVLSYQRPDEEAVVDQGGTSTILNIHYEKEELEGHRTLYVGVRMPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRVRSMVSDFAVFLTIFTMVIIDFLIGVPSPKLQVPSVFKPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFIPMPVLYGVFLYMGVSSLQGIQFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEVIVLAPTVYLGASNYRT

SEQ ID NO: 795020 - protein, 1130 aa, Homo sapiens
VLPREELQATATSRERRQEGPAWPSPFILLSGVVRRKRKRRRLAEEEDNYIESVVKFRSMFNKNNSNKLRSTPRYRRGDPGYLNFTELGPLKPEQKDQWSQHRPDEEAVVDQGGTSTILNIHYEKEELEGHRTLYVGVRMPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRVRSMVSDFAVFLTIFTMVIIDFLIGVPSPKLQVPSVFKPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFIPMPVLYGVFLYMGVSSLQGIQFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEVIVLAPTVYLGASNYRT

SEQ ID NO: 795021 - protein, 920 aa, Homo sapiens
MKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSECQEMHGEFMGSACGHHGPYTPDVLFWSCILFFTTFILSSTLKTFKTSRYFPTRVRSMVSDFAVFLTIFTMVIIDFLIGVPSPKLQVPSVFKPTRDDRGWIINPIGPNPWWTVIAAIIPALLCTILIFMDQQITAVIINRKEHKLKKGCGYHLDLLMVAIMLGVCSIMGLPWFVAATVLSITHVNSLKLESECSAPGEQPKFLGIREQRVTGLMIFVLMGCSVFMTAILKFIPMPVLYGVFLYMGVSSLQGIQFFDRLKLFGMPAKHQPDFIYLRHVPLRKVHLFTLIQLTCLVLLWVIKASPAAIVFPMMVLALVFVRKVMDLCFSKRELSWLDDLMPESKKKKLDDAKKKAKEEEVIVLAPTVYLGASNYRT

SEQ ID NO: 795022 - protein, 691 aa, Homo sapiens
MPAAGSNEPDGVLSYQRPDEEAVVDQGGTSTILNIHYEKEELEGHRTLYVGVRMPLGRQSHRHHRTHGQKHRRRGRGKGASQGEEGLEALAHDTPSQRVQFILGTEEDEEHVPHELFTELDEICMKEGEDAEWKETARWLKFEEDVEDGGERWSKPYVATLSLHSLFELRSCLINGTVLLDMHANSIEEISDLILDQQELSSDLNDSMRVKVREALLKKHHHQNEKKRNNLIPIVRSFAEVGKKQSDPHLMDKHGQTVSPQSVPTTNLEVKNGVNCEHSPVDLSKVDLHFMKKIPTGAEASNVLVGEVDILDRPIVAFVRLSPAVLLSGLTEVPIPTRFLFILLGPVGKGQQYHEIGRSMATIMTDEIFHDVAYKAKERDDLLAGIDEFLDQVTVLPPGEWDPSIRIEPPKNVPSQEKRKMPGVPNGNVCHIEQEPHGGHSGPELQRTGRLFGGLVLDIKRKAPWYWSDYRDALSLQCLASFLFLYCACMSPVITFGGLLGEATEGRISAIESLFGASMTGIAYSLFAGQALTILGSTGPVLVFEKILFKFCKDYALSYLSLRACIGLWTAFLCIVLVATDASSLVCYITRFTEEAFASLICIIFIYEAIEKLIHLAETYPIHMHSQLDHLSLYYCRCTLPENPNNHTLQYWKDHNIVTAEVHWANLTVSVSLGAARCPSIVTTGLGGTSK

SEQ ID NO: 795023 - protein, 218 aa, Homo sapiens
MDWNGLQWNEMEWNGMESIIPSGMEGNVMEWKEGNGINPSGMQGNGMEWKGMEWNQLDCNEWNGMEWNGMELIGIEWNGMEWNGTEWNQHECRGMEWNGMQWNGIIRNGMEWNGINSIAMEWNGMEWNRRNGINPNRMECNRMECNGTEWSGMEWNIINPSTGEWNGMECNGMESSVMEWKEWNGMEWNGMEWNGINSMAIEWNAMELTRIEWNGMEW

SEQ ID NO: 795024 - protein, 75 aa, Homo sapiens
CEDCGGGLRFIPRHTGLINNSVIVLDFVSHVNYTFEIEAMNGVSELSFSPKPFTAITVTTDQDGKFHCCSLKTDP

SEQ ID NO: 795025 - protein, 105 aa, Homo sapiens
GALLQGPGPPPGHSSHLDDEGSRRHPQPWNSLFQIRDPGENREDGHLDRKRLLCPEQQQRWSLKPSPGSAPHRRKESPSHQALGTNNTNSSLLAIHFPICFCFFL

SEQ ID NO: 795026 - protein, 67 aa, Homo sapiens
TVCRSHRFPFQPPAPLAFDLSKARGGMGAAGLGPLSLLESDVASMRVRPGPQVPPESVGLGPGPGAL

SEQ ID NO: 795027 - protein, 695 aa, Homo sapiens [sequence omitted]

SEQ ID NO: 795028 - protein, 37 aa, Homo sapiens
MPTSEEHLCRLSDPPAVSACSRCSAMLPRPGHSAAHS

SEQ ID NO: 795029 - protein, 111 aa, Homo sapiens
MWMGLIQLVEGVKRKDQGFLEKEFYHKTNIKMHCEFHACWPAFTVLGEAWRDQVDWSRLLRDAGLVKMSRKPRASSPLSNNHPPTPKGRFPRQPGREKGPIKEVPGTKGSP

SEQ ID NO: 795030 - protein, 73 aa, Homo sapiens
SLGSRQGWNRILPGWGSGWGGGGLIWEAEHSSPNLLVMSAATEERPRMDRLIKGHLQATNKAITRSQPRQSLI

SEQ ID NO: 795031 - protein, 135 aa, Homo sapiens
MWMGLIQLVEGVKRKDQGFLEKEFYHKTNIKMHCEFHACWPAFTVLGEAWRDQVDWSRLLRDAGLVKMSRKPRASSPLSNNHPPTPKGRKWKASSQPWPRSPIKVPKTTRKGKGTHQGSSRNKRLSLKDRRFKKT

SEQ ID NO: 795032 - protein, 73 aa, Homo sapiens; identical to SEQ ID NO: 795030

SEQ ID NO: 795033 - protein, 145 aa, Homo sapiens
GESEDVTQFLQSHKKTLTNEKLFLMDGKRTWFLEMESTPGEDAMNTVKMTTKDLKYDRSLIDKAGFERTDSNFERSHTVGKMLSNSIMCYRDIFYERESQLMQQTSLLSYEIAIATPTFSNYYPDWSAPINIVARPSTSKKIMTC

SEQ ID NO: 795034 - protein, 42 aa, Homo sapiens
RRCGEQAVSTGAEVGSSQQCSGVARCKRLFQETAIVGMDSVW

SEQ ID NO: 795035 - protein, 129 aa, Homo sapiens [sequence omitted]

SEQ ID NO: 795036 - protein, 1857 aa, Homo sapiens
MARKKLKKFTTLEIVLSVLLLVLFIISIVLIVLLAKESLKSTAPDPGTTGTPDPGTTGTPDPGTTGTTHARTTGPPDPGTTGTTPVSAECPVVNELERINCIPDQPPTKATCDQRGCCWNPQGAVSVPWCYYSKNHSYHVEGNLVNTNAGFTARLKNLPSSPVFGSNVDNVLLTAEYQTSNRFHFKLTDQTNNRFEVPHEHVQSFSGNAAASLTYQVEISRQPFSIKVTRRSNNRVLFDSSIGPLLFADQFLQLSTRLPSTNVYGLGEHVHQQYRHDMNWKTWPIFNRDTTPNGNGTNLYGAQTFFLCLEDASGLSFGVFLMNSNAMEVVLQPAPAITYRTIGGILDFYVFLGNTPEQVVQEYLELIGRPALPSYWALGFHLSRYEYGTLDNMREVVERNRAAQLPYDVQHADIDYMDERRDFTYDSVDFKGFPEFVNELHNNGQKLVIIVDPAISNNSSSSKPYGPYDRGSDMKIWVNSSDGVTPLIGEVWPGQTVFPDYTNPNCAVWWTKEFELFHNQVEFDGIWIDMNEVSNFVDGSVSGCSTNNLNNPPFTPRILDGYLFCKTLCMDAVQHWGKQYDIHNLYGYSMAVATAEAAKTVFPNKRSFILTRSTFAGSGKFAAHWLGDNTATWDDLRWSIPGVLEFNLFGIPMVGPDICGFALDTPEELCRRWMQLGAFYPFSRNHNGQGYKDQDPASFGADSLLLNSSRHYLNIRYTLLPYLYTLFFRAHSRGDTVARPLLHEFYEDNSTWDVHQQFLWGPGLLITPVLDEGAEKVMAYVPDAVWYDYETGSQVRWRKQKVEMELPGDKIGLHLRGGYIFPTQQPNTTTLASRKNPLGLIIALDENKEAKGELFWDDGETKDTVANKVYLLCEFSVTQNRLEVNISQSTYKDPNNLAFNEIKILGTEEPSNVTVKHNGVPSQTSPTVTYDSNLKVAIITDIDLLLGEAYTVEWSIKIRDEEKIDCYPDENGASAENCTARGCIWEASNSSGVPFCYFVNDLYSVSDVQYNSHGATADISLKSSVYANAFPSTPVNPLRLDVTYHKNEMPQFKIYDPNKNRYEVPVPLNIPSMPSSTPEGQLYDVLIKKNPFGIEIRRKSIGTIIWDSQLLGFTFSDMFIRISTRLPSKYLYGFGETEHRSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEIASLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPHLESRDRGLSSKTLCMESQQILPDGSLVQHYNVHNLYGWSQTRPTYEAVQEVTGQRGVVITRSTFPSSGRWAGHWLGDNTAAWDQLKKSIIGMTEFSLFGISYTGADICGFFQDAEYEMCVRWMQLGAFYPFSRNHNTIGTRRQDPVSWDVAFVNISRTVLQTRYTLLPYLYTLMQKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRQKFMGFKIALDDEGTAGGWLFWDDGQSIDTYGKGLYYLASFSASQNTMQSHIIFNNYITGTNPLKLGYIEIWGVGSVPVTSASISVSGMVITPSFNNDPTTQVLSIDVTDRNISLHNFTSLTWISTL

SEQ ID NO: 795037 - protein, 801 aa, Homo sapiens
MARKKLKKFTTLEIVLSVLLLVLFIISIVLIVLLAKESLKSTAPDPGTTGTPDPGTTGTPDPGTTGTTHARTTGPPDPGTTGTTPVSAECPVVNELERINCIPDQPPTKATCDQRGCCWNPQGAVSVPWCYYSKNHSYHVEGNLVNTNAGFTARLKNLPSSPVFGSNVDNVLLTAEYQTSNRFHFKLTDQTNNRFEVPHEHVQSFSGNAAASLTYQVEISRQPFSIKVTRRSNNRVLFDSSIGPLLFADQFLQLSTRLPSTNVYGLGEHVHQQYRHDMNWKTWPIFNRDTTPNGNGTNLYGAQTFFLCLEDASGLSFGVFLMNSNAMEVVLQPAPAITYRTIGGILDFYVFLGNTPEQVVQEYLELIGRPALPSYWALGFHLSRYEYGTLDNMREVVERNRAAQLPYDVQHADIDYMDERRDFTYDSVDFKGFPEFVNELHNNGQKLVIIVDPAISNNSSSSKPYGPYDRGSDMKIWVNSSDGVTPLIGEVWPGQTVFPDYTNPNCAVWWTKEFELFHNQVEFDGIWIDMNEVSNFVDGSVSGCSTNNLNNPPFTPRILDGYLFCKTLCMDAVQHWGKQYDIHNLYGYSMAVATAEAAKTVFPNKRSFILTRSTFAGSGKFAAHWLGDNTATWDDLRWSIPGVLEFNLFGIPMVGPDICGFALDTPEELCRRWMQLGAFYPFSRNHNGQGYKDQDPASFGADSLLLNSSRHYLNIRYTLLPYLYTLFFRAHSRGDTVARPLLHEFYEDNSTWDVHQQFLWGPGLLITPVLDEGAEKVMAYVPDAVWYDYETVSSFDFSSTP

SEQ ID NO: 795038 - protein, 1742 aa, Homo sapiens
MARKKLKKFTTLEIVLSVLLLVLFIISIVLIVLLAKESLKSTAPDPGTTGTPDPGTTGTPDPGTTGTTHARTTGPPDPGTTGTTPVSAECPVVNELERINCIPDQPPTKATCDQRGCCWNPQGAVSVPWCYYSKNHSYHVEGNLVNTNAGFTARLKNLPSSPVFGSNVDNVLLTAEYQTSNRFHFKLTDQTNNRFEVPHEHVQSFSGNAAASLTYQVEISRQPFSIKVTRRSNNRVLFDSSIGPLLFADQFLQLSTRLPSTNVYGLGEHVHQQYRHDMNWKTWPIFNRDTTPNGNGTNLYGAQTFFLCLEDASGLSFGVFLMNSNAMEVVLQPAPAITYRTIGGILDFYVFLGNTPEQVVQEYLELIGRPALPSYWALGFHLSRYEYGTLDNMREVVERNRAAQLPYDVQHADIDYMDERRDFTYDSVDFKGFPEFVNELHNNGQKLVIIVDPAISNNSSSSKPYGPYDRGSDMKIWVNSSDGVTPLIGEVWPGQTVFPDYTNPNCAVWWTKEFELFHNQVEFDGIWIDMNEVSNFVDGSVSGCSTNNLNNPPFTPRILDGYLFCKTLCMDAVQHWGKQYDIHNLYGYSMAVATAEAAKTVFPNKRSFILTRSTFAGSGKFAAHWLGDNTATWDDLRWSIPGVLEFNLFGIPMVGPDICGFALDTPEELCRRWMQLGAFYPFSRNHNGQGYKDQDPASFGADSLLLNSSRHYLNIRYTLLPYLYTLFFRAHSRGDTVARPLLHEFYEDNSTWDVHQQFLWGPGLLITPVLDEGAEKVMAYVPDAVWYDYETGSQVRWRKQKVEMELPGDKIGLHLRGGYIFPTQQPNTTTLASRKNPLGLIIALDENKEAKGELFWDDGETKDTVANKVYLLCEFSVTQNRLEVNISQSTYKDPNNLAFNEIKILGTEEPSNVTVKHNGVPSQTSPTVTYDSNLKVAIITDIDLLLGEAYTVEWSIKIRDEEKIDCYPDENGASAENCTARGCIWEASNSSGVPFCYFVNDLYSVSDVQYNSHGATADISLKSSVYANAFPSTPVNPLRLDVTYHKNEMPQFKIYDPNKNRYEVPVPLNIPSMPSSTPEGQLYDVLIKKNPFGIEIRRKSIGTIIWDSQLLGFTFSDMFIRISTRLPSKYLYGFGETEHRSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEIASLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPHLESRDRGLSSKTLCMESQQILPDGSLVQHYNVHNLYGWSQTRPTYEAVQEVTGQRGVVITRSTFPSSGRWAGHWLGDNTAAWDQLKKSIIGMTEFSLFGISYTGADICGFFQDAEYEMCVRWMQLGAFYPFSRNHNTIGTRRQDPVSWDVAFVNISRTVLQTRYTLLPYLYTLMQKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRKNPLGLIIALDE

SEQ ID NO: 795039 - protein, 446 aa, Homo sapiens
LPSGPCGPQPSPFLSSTGAPPGGRAEGSPGRCQGAILEGGREEEVRAAMHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELHRLGSHPAPARAQKPGSSGLAARGLCVLGEDNAPL

SEQ ID NO: 795040 - protein, 292 aa, Homo sapiens
PGNALECVSPVQDDLLIPRRAAFPVWVPERTALLTCPLGAAPGSSREAPGIAGPPNSTAMSKLGKFFKGGGSSKSRAAPSPQEALVRLRETEEMLGKKQEYLENRIQREIALAKKHGTQNKRAALQALKRKKRFEKQLTQIDGTLSTIEFQREALENSHTNTEVLRNMGFAAKAMKSVHENMDLNKIDDLMQEITEQQDIAQEISEAFSQRVGFGDDFDEDELMAELEELEQEELNKKMTNIRLPNVPSSSLPAQPNRKPGMSSTARRSRAASSQRAEEEDDDIKQLAAWAT

SEQ ID NO: 795041 - protein, 150 aa, Homo sapiens
DAWVTISDSHSVLSKMKGSIFTLFLFSVLFAISEVRSKESVRLCGLEYIRTVIYICASSRWRRHLEGIPQAQQAETGNSFQLPHKREFSEENPAQNLPKVDASGEDRLWGGQMPTEELWKSKKHSVMSRQDLQTLCCTDGCSMTDLSALC

SEQ ID NO: 795042 - protein, 89 aa, Homo sapiens
RHLASHPVLGPVLQNSSSALCPHLLLAESPRFHLPQPSQTCAFFSNPRSVITLSLSQIKNSLLTCSLLPALPVLLMLHTAPKITFKIQI

SEQ ID NO: 795043 - protein, 74 aa, Homo sapiens
EIPEEQSISRGRGEQVKGLGSASMMKVHLRGFADGRDVGCARRSHHSVGLPLTDMGKVMARVMVVRIQGCVVWL

SEQ ID NO: 795044 - protein, 107 aa, Homo sapiens
GVGTGEKPCAQDLWPKVPLPLLGSHLELEILHCELSWHRKVLEGKLREMLSEFSSLLSTEFSPSVVRGVFPARLSHRSWSPPCYSPGFASLLICLSFSRFLFMEPPL

SEQ ID NO: 795045 - protein, 151 aa, Homo sapiens
STRLQLAIEASAESLASLQRQITSVAQVAAQNRRALDLLTAEKGGTCLFLQEECCYYLNVSGVVETNLQTLKKKDPRGVKTFLGPSPPWSFLVVFTCGSTDAPFPYPNYNSLYNNVFCPNPSTVSPPADTRNHQGHFQPDVTSPLRPTANL

SEQ ID NO: 795046 - protein, 185 aa, Homo sapiens
SSLHVASCYVCGGMNMGDQWPWEARELMPQDNFTLTASSLEPAPSSQSIWFLKTSIIGKFCIARWGKAFTDPVGELTCLGQQYYNETLGKTLWRGKSNNSESPRRALMHKNKVLSMLKEPPLHEKCEDGKTETTFEMSMHNTMKSKSPLPLTLQHLVAFWEDISLATIKAASQNMIFPSPGSCAV

SEQ ID NO: 795047 - protein, 83 aa, Homo sapiens
SSSDMRVDFIFRYGVFTESDSTQYWQKPTRSIIKQKLPGSSPLKEWLCPFDVEPAMLPISLTVKSRGLTTSCATWPSFIPLAS

SEQ ID NO: 795048 - protein, 408 aa, Homo sapiens
MSACPTTLTLSPPHTMHLFNTLLCLVFSFTSHIDRNQGFTFLLESCFFPGLELRDEDGSSRRTEAHLGDEILPGEGKHSLYFAHFKSEASNHLLPLTLQAHFHTPSPLRSPTPPHHHSATRNAACRTQEPSLWVGFLVSADRLLVSRSSSIRKPGIFILPRSSMLPSPPVFRDFALPQAPAHLSHRWALVAPQEERGAAGARSRSAGTDSTLGVWAACHEEQRSHRSRFRRRPDTEDPERRAAPPRNALTGAKFSHPGSEGGGEGSGTRGGGAGLCAGGCGAGAQDPNFSEVGPRRGGWRRRGQGLPQVRSEAPPHGRGQESQELGSRQQSPVRDRELPGPQSALPTALRGCRLRSNCKRHGPCLLFTAFSLETPANVLERRGIPALSILVSTLAPWCKPTAEAACPG

SEQ ID NO: 795049 - protein, 106 aa, Homo sapiens
MFTAQIFLQPYCLTTGMNYFTICCKRMGHVLCQQQKIQKLVRITCPPGASPTWIPLSAQFFHPYCLLPSGIMNSSWKRTLLFNISALSCAVRLTRKLPCFSPSFGL

SEQ ID NO: 795050 - protein, 106 aa, Homo sapiens; identical to SEQ ID NO: 795049

SEQ ID NO: 795051 - protein, 106 aa, Homo sapiens; identical to SEQ ID NO: 795049

SEQ ID NO: 795052 - protein, 115 aa, Homo sapiens
EQPGLSHLANIYGAPTVCRHCPSARTGKEQVHLCPQGTYHLANGSSSQTTNYAINFSVDCSIIIGLYQITDKYLNPAVGKVPCNVQMGIPKKMKQSVPPFRVHSLADNTGTHSCH

SEQ ID NO: 795053 - protein, 104 aa, Homo sapiens
MHSMLLWADQNSALAFASYLHRALRSARDERLRPSQGLGLYIDLHLHGFLMPGICQSFSKAIYVPGSLWLGLLGSSNSVLLSFPTVLARLLDSISYYYSEAIDF

SEQ ID NO: 795054 - protein, 112 aa, Homo sapiens
GLPGAARREPRGAGGRRTPSLAACAPGRPPARDGTGSMSSGYSSLEEDAEDFFFTARTSFFRRAPQGKPRSGQQHAVGSTSWEKMGRELVPVSPAVAVFFGRPSRNGARRLD

SEQ ID NO: 795055 - protein, 227 aa, Homo sapiens
GLPGAARREPRGAGGRRTPSLAACAPGRPPARDGTGSMSSGYSSLEEDAEDFFFTARTSFFRRAPQGKPRSGQQDVEKEKETHSYLSKEEIKEKVHKYNLAVTDKLKMTLNSNGIYTGFIKVQMELCKPPQTSPNSGKLSPSSNGCMNTLHISSTNTVGEVIEALLKKFLVTESPAKFALYKRCHREDQVYACKLSDREHPLYLRLVAGPRTDTLSFVLREHEIGEV

SEQ ID NO: 795056 - protein, 147 aa, Homo sapiens
DPEKMWRELRGCPGGDVETAQRLSQRRRGKSSEAVPEKTWRSSEDVPEKTWREFRGCPGEDVERAQKLRDCPGEDMETAQRLSARRRAESSEAVPEKTWRELKGCPQEDVERVQRLSLLLHLAVFLWIIIAINFSNSGVKSQSSTYL

SEQ ID NO: 795057 - protein, 103 aa, Homo sapiens
ECHPSLTDPQTENQRHPGRSFFPGTLPKLPETPPKLSRKSVREILIQQICVSCLLGTLAEVGNTMVNEPQSLPSVAHPGEGQLHPPRQTPNWKYTPNLYPRYT

SEQ ID NO: 795058 - protein, 553 aa, Homo sapiens
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQTILEEDVEDPVYQYIVFEAGHEPIRDPETEENIYQVPTSQKKEGVYDVPKSQPAVTQLELFGDMSTPPDITSPPTPATPGDAFIPSSSQTLPASADVFSSVPFGTAAVPSGYVAMGAVLPSFWGQQPLVQQQMVMGAQPPVAQVMPGAQPIAWGQPGLFPATQQPWPTVAGQFPPAAFMPTQTVMPLPAAMFQGPLTPLATVPGTSDSTRSSPQTDKPRQKMGKETFKDFQMAQPPPVPSRKPDQPSLTCTSEAFSSYFNKVGVAQDTDDCDDFDISQLNLTPVTSTTPSTNSPPTPAPRQSSPSKSSASHASDPTTDDIFEEGFESPSKSEEQEAPDGSQASSNSDPFGEPSGEPSGDNISPQAGS

SEQ ID NO: 795059 - protein, 553 aa, Homo sapiens; identical to SEQ ID NO: 795058

SEQ ID NO: 795060 - protein, 189 aa, Homo sapiens
MSTETELQVAVKTSAKKDSRKKGQDRSEATLIKRFKGEGVRYKAKLIGIDEVSAARGDKLCQDSMMKLKGVVAGARSKGEHKQKIFLTISFGGIKIFDEKTGALQHHHAVHEISYIAKDITDHRAFGYVCGKEGNHRFVAIKTAQAAEPVILDLRDLFQLIYELKQREELEKKAQKDKQCEQAVYQVYL

SEQ ID NO: 795061 - protein, 86 aa, Homo sapiens
KAHLTPRGTARGEGAAWHIWNPGAAGEHLSGNQCVAFCQVPSHALGPQSVSLSPIRIFHPFCFQAIFVIHCCLFVVSPDDICRGPL

SEQ ID NO: 795062 - protein, 142 aa, Homo sapiens
KRNRQPLTSNPLKDDSGISTPSDNYDFPPLPTDWAWEAVNPELAPVMKTVDTGQIPHSVSRPLRSQDSVFNSIQSNTGRSQGGWSYRDGNKNTSLKTWNKNDFKPQCVSVRPASVSEQKTFQAFVKIADVEMQYYINVMNET

SEQ ID NO: 795063 - protein, 174 aa, Homo sapiens
KRNRQPLTSNPLKDDSGISTPSDNYDFPPLPTDWAWEAVNPELAPVMKTVDTGQIPHSVSRPLRSQDSVFNSIQSNTGRSQGGWSYRDGNKNTSLKTWNKNDFKPCVFYEIDRELPRLIRGRVHRCVGNYDQKKNIFQCVSVRPASVSEQKTFQAFVKIADVEMQYYINVMNET

SEQ ID NO: 795064 - protein, 344 aa, Homo sapiens
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEYVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 795065 - protein, 344 aa, Homo sapiens; identical to SEQ ID NO: 795064

SEQ ID NO: 795066 - protein, 356 aa, Homo sapiens [sequence omitted]

SEQ ID NO: 795067 - protein, 424 aa, Homo sapiens
MGSLVLTLCALFCLAAYLVSGSPIMNLEQSPLEEDMSLFGDVFSEQDGVDFNTLLQSMKDEFLKTLNLSDIPTQDSAKVDPPEYMLELYNKFATDRTSMPSANIIRSFKNEDLFSQPVSFNGLRKYPLLFNVSIPHHEEVIMAELRLYTLVQRDRMIYDGVDRKITIFEVLESKGDNEGERNMLVLVSGEIYGTNSEWETFDVTDAIRRWQKSGSSTHQLEVHIESKHDEAEDASSGRLEIDTSAQNKHNPLLIVFSDDQSSDKERKEELNEMISHEQLPELDNLGLDSFSSGPGEEALLQMRSNIIYDSTARIRRNAKGNYCKRTPLYIDFKEIGWDSWIIAPPGYEAYECRGVCNYPLAEHLTPTKHAIIQALVHLKNSQKASKACCVPTKLEPISILYLDKGVVTYKFKYEGMAVSECGCR

SEQ ID NO: 795068 - protein, 661 aa, Homo sapiens
MDLQQSTTITSLEKWCLDESLSGCRRHYSVKKKLKLIRVLGLFMGLVAISTVSFSISAFSETDTQSTGEASVVSGPRVAQGYHQRTLLDLNDKILDYTPQPPLSKEGESENSTDHAQGDYPKDIFSLEERRKGAIILHVIGMIYMFIALAIVCDEFFVPSLTVITEKLGISDDVAGATFMAAGGSAPELFTSLIGVFIAHSNVGIGTIVGSAVFNILFVIGMCALFSREILNLTWWPLFRDVSFYIVDLIMLIIFFLDNVIMWWESLLLLTAYFCYVVFMKFNVQVEKWVKQMINRNKVVKVTAPEAQAKPSAARDKDEPTLPAKPRLQRGGSSASLHNSLMRNSIFQLMIHTLDPLAEELGSYGKLKYYDTMTEEGRFREKASILHKIAKKKCHVDENERQNGAANHVEKIELPNSTSTDVEMTPSSDASEPVQNGNLSHNIEGAEAQTADEEEDQPLSLAWPSETRKQVTFLIVFPIVFPLWITLPDVRKPSSRKFFPITFFGSITWIAVFSYLMVWWAHQVGETIGISEEIMGLTILAAGTSIPDLITSVIVARKGLGDMAVSSSVGSNIFDITVGLPLPWLLYTVIHRFQPVAVSSNGLFCAIVLLFIMLLFVILSIALCKWRMNKILGFIMFGLYFVFLVVSVLLEDRILTCPVSI

SEQ ID NO: 795069 - protein, 644 aa, Homo sapiens
MDLQQSTTITSLEKWCLDESLSGCRRHYSVKKKLKLIRVLGLFMGLVAISTVSFSISAFSETDTQSTGEASVVSGPRVAQGYHQRTLLDLNDKILDYTPQPPLSKEGESENSTDHAQGDYPKDIFSLEERRKGAIILHVIGMIYMFIALAIVCDEFFVPSLTVITEKLGISDDVAGATFMAAGGSAPELFTSLIGVFIAHSNVGIGTIVGSAVFNILFVIGMCALFSREILNLTWWPLFRDVSFYIVDLIMLIIFFLDNVIMWWESLLLLTAYFCYVVFMKFNVQVEKWVKQMINRNKVVKVTAPEAQAKPSAARDKDEPTLPAKPRLQRGGSSASLHNSLMRNSIFQLMIHTLDPLAEGRFREKASILHKIAKKKCHVDENERQNGAANHVEKIELPNSTSTDVEMTPSSDASEPVQNGNLSHNIEGAEAQTADEEEDQPLSLAWPSETRKQVTFLIVFPIVFPLWITLPDVRKPSSRKFFPITFFGSITWIAVFSYLMVWWAHQVGETIGISEEIMGLTILAAGTSIPDLITSVIVARKGLGDMAVSSSVGSNIFDITVGLPLPWLLYTVIHRFQPVAVSSNGLFCAIVLLFIMLLFVILSIALCKWRMNKILGFIMFGLYFVFLVVSVLLEDRILTCPVSI

SEQ ID NO: 795070 - protein, 311 aa, Homo sapiens
LCVFYCDVVELGSYGKLKYYDTMTEEGRFREKASILHKIAKKKCHVDENERQNGAANHVEKIELPNSTSTDVEMTPSSDASEPVQNGNLSHNIEGAEAQTADEEEDQPLSLAWPSETRKQVTFLIVFPIVFPLWITLPDVRKPSSRKFFPITFFGSITWIAVFSYLMVWWAHQVGETIGISEEIMGLTILAAGTSIPDLITSVIVARKGLGDMAVSSSVGSNIFDITVGLPLPWLLYTVIHRFQPVAVSSNGLFCAIVLLFIMLLFVILSIALCKWRMNKILGFIMFGLYFVFLVVSVLLEDRILTCPVSI

SEQ ID NO: 795071 - protein, 1955 aa, Homo sapiens
MFRQFYLWTCLASGIILGSLFEICLGQYDDDCKLARGGPPATIVAIDEESRNGTILVDNMLIKGTAGGPDPTIELSLKDNVDYWVLMDPVKQMLFLNSTGRVLDRDPPMNIHSIVVQVQCINKKVGTIIYHEVRIVVRDRNDNSPTFKHESYYATVNELTPVGTTIFTGFSGDNGATDIDDGPNGQIEYVIQYNPDDPTSNDTFEIPLMLTGNIVLRKRLNYEDKTRYFVIIQANDRAQNLNERRTTTTTLTVDVLDGDDLGPMFLPCVLVPNTRDCRPLTYQAAIPELRTPEELNPIIVTPPIQAIDQDRNIQPPSDRPGILYSILVGTPEDYPRFFHMHPRTAELSLLEPVNRDFHQKFDLVIKAEQDNGHPLPAFAGLHIEILDENNQSPYFTMPSYQGYILESAPVGATISDSLNLTSPLRIVALDKDIEDTKDPELHLFLNDYTSVFTVTQTGITRYLTLLQPVDREEQQTYTFSITAFDGVQESEPVIVNIQVMDANDNTPTFPEISYDVYVYTDMRPGDSVIQLTAVDADEGSNGEITYEILVGAQGDFIINKTTGLITIAPGVEMIVGRTYALTVQAADNAPPAERRNSICTVYIEVLPPNNQSPPRFPQLMYSLEISEAMRVGAVLLNLQATDREGDSITYAIENGDPQRVFNLSETTGILTLGKALDRESTDRYILIITASDGRPDGTSTATVNIVVTDVNDNAPVFDPYLPRNLSVVEEEANAFVGQVKATDPDAGINGQVHYSLGNFNNLFRITSNGSIYTAVKLNREVRDYYELVVVATDGAVHPRHSTLTLAIKVLDIDDNSPVFTNSTYTVLVEENLPAGTTILQIEAKDVDLGANVSYRIRSPEVKHFFALHPFTGELSLLRSLDYEAFPDQEASITFLVEAFDIYGTMPPGIATVTVIVKDMNDYPPVFSKRIYKGMVAPDAVKGTPITTVYAEDADPPGLPASRVRYRVDDVQFPYPASIFEVEEDSGRVITRVNLNEEPTTIFKLVVVAFDDGEPVMSSSATVKILVLHPGEIPRFTQEEYRPPPVSELATKGTMVGVISAAAINQSIVYSIVSGNEEDTFGINNITGVIYVNGPLDYETRTSYVLRVQADSLEVVLANLRVPSKSNTAKVYIEIQDENNHPPVFQKKFYIGGVSEDARMFTSVLRVKATDKDTGNYSVMAYRLIIPPIKEGKEGFVVETYTGLIKTAMLFHNMRRSYFKFQVIATDDYGKGLSGKADVLVSVVNQLDMQVIVSNVPPTLVEKKIEDLTEILDRYVQEQIPGAKVVVESIGARRHGDAFSLEDYTKCDLTVYAIDPQTNRAIDRNELFKFLDGKLLDINKDFQPYYGEGGRILEIRTPEAVTSIKKRGESLGYTEGALLALAFIIILCCIPAILVVLVSYRQFKVRQAECTKTARIQAALPAAKPAVPAPAPVAAPPPPPPPPPGAHLYEELGDSSILFLLYHFQQSRGNNSVSEDRKHQQVVMPFSSNTIEAHKSAHVDGSLKSNKLKSARKFTFLSDEDDLSAHNPLYKENISQVSTNSDISQRTDFVDPFSPKIQAKSKSLRGPREKIQRLWSQSVSLPRRLMRKVPNRPEIIDLQQWQGTRQKAENENTGICTNKRGSSNPLLTTEEANLTEKEEIRQGETLMIEGTEQLKSLSSDSSFCFPRPHFSFSTLPTVSRTVELKSEPNVISSPAECSLELSPSRPCVLHSSLSRRETPICMLPIETERNIFENFAHPPNISPSACPLPPPPPISPPSPPPAPAPLAPPPDISPFSLFCPPPSPPSIPLPLPPPTFFPLSVSTSGPPTPPLLPPFPTPLPPPPPSIPCPPPPSASFLSTECVCITGVKCTTNLMPAEKIKSSMTQLSTTTVCKTDPQREPKGILRHVKNLAELEKSVANMYSQIEKNYLRTNVSELQTMCPSEVTNMEITSEQNKGSLNNIVEGTEKQSHSQSTSL

SEQ ID NO: 795072 - protein, 1955 aa, Homo sapiens; identical to SEQ ID NO: 795071

SEQ ID NO: 795073 - protein, 323 aa, Homo sapiens
MGLFDRGVQMLLTTVGAFAAFSLMTIAVGTDYWLYSRGVCKTKSVSENETSKKNEEVMTHSGLWRTCCLEGNFKGLCKQIDHFPEDADYEADTAEYFLRAVRASSIFPILSVILLFMGGLCIAASEFYKTRHNIILSAGIFFVSAGLSNIIGIIVYISANAGDPSKSDSKKNSYSYGWSFYFGALSFIIAEMVGVLAVHMFIDRHKQLRATARATDYLQASAITRIPSYRYRYQRRSRSSSRSTEPSHSRDASPVGIKGFNTLPSTEISMYTLSRDPLKAATTPTATYNSDRDNSFLQVHNCIQKENKDSLHSNTANRRTTPV

SEQ ID NO: 795074 - protein, 133 aa, Homo sapiens
MKARDRGRPTQLSPPLRLPCGRLPEKLTSFSLIPHPATLRPAGLSNIIGIIVYISANAGDPSKSDSKKNSYSYGWSFYFGALSFIIAEMVGVLAVHMFIDRHKQLRATARATDYLQASAITRIPSYRYRYQRR

SEQ ID NO: 795075 - protein, 151 aa, Homo sapiens
ALNIVIGFPALSLSFCSIELKALLSLICLRLQTRSKRSGAQSSRHVRTIQCDVLPGMINSGDLINLRVQISDEVSFQPGIPVQAHVRLRKIDDTIKESSFHHHDAPSSKRAHPSRLSLEGFECLSDQSTGPLNEHLFIVPVIFSEDSSGSR

SEQ ID NO: 795076 - protein, 296 aa, Homo sapiens
MSACGRKALTLLSSVFAVCGLGLLGIAVSTDYWLYLEEGVIVPQNQSTEIKMSLHSGLWRVCFLAGEERGRCFTIEYVMPMNTQLTSESTVNVLKMIRSATPFPLVSLFFMFIGFILNNIGHIRPHRTILAFVSGIFFILSGLSLVVGLVLYISSINDEMLNRTKDAETYFNYKYGWSFAFAAISFLLTEVKPVTLSMDRLGLGTAPLSRGEWGWGRRDIPQPFWTPDHPLYFPSSSQNVSLSYLSGSPPARMSPGPCSCPHVHFPPHSSCVLCRPQPREMRQAPAASPSSAVFSL

SEQ ID NO: 795077 - protein, 121 aa, Homo sapiens
DSASFLCFLVKTGFHHVGQAGLELLTSGDPPSLASQSAGITGLSRCARPPFLCVCVCVGLGEGTFIQISLKEMLVTASTSGERTRGLGIGGGHTCTFLYVPFVKIAFLKTMHMCHLLQIKN

SEQ ID NO: 795078 - protein, 122 aa, Homo sapiens
TGTPGLLLSNQPGAHGVGLGILGKAGPGGFGGEGLSDPLMTFVSLSRYSPYLPPPTCPPPHVSMGTYLAPHPPSSGPLLSTPRFPSCLSSLVTEQNSISKRERERGRERERKKGKERKKGER

SEQ ID NO: 795079 - protein, 337 aa, Homo sapiens
MDETGNLTVSSATCHDTIDDFRNQVYSTLYSMISVVGFFGNGFVLYVLIKTYHKKSAFQVYMINLAVADLLCVCTLPLRVVYYVHKGIWLFGDFLCRLSTYALYVNLYCSIFFMTAMSFFRCIAIVFPVQNINLVTQKKARFVCVGIWIFVILTSSPFLMAKPQKDEKNNTKCFEPPQDNQTKNHVLVLHYVSLFVGFIIPFVIIIVCYTMIILTLLKKSMKKNLSSHKKAIGMIMVVTAAFLVSFMPYHIQRTIHLHFLHNETKPCDSVLRMQKSVVITLSLAASNCCFDPLLYFFSGGNFRKRLSTFRKHSLSSVTYVPRKKASLPEKGEEICKV

SEQ ID NO: 795080 - protein, 74 aa, Homo sapiens
MLSVPSATAPWQPLPRLHTSDSTLSGASLHAAAKGGFLQQTADVSSRMDSTLLSLPEGPDRCPLRPQAWMPGPF

SEQ ID NO: 795081 - protein, 58 aa, Homo sapiens
MLSPNTDIKGPDFSEYRRLEVLDSTKSSRESSEARKGFSYLVTGVTTVGVAYAATNAV

SEQ ID NO: 795082 - protein, 119 aa, Homo sapiens [sequence omitted]

SEQ ID NO: 795083 - protein, 240 aa, Homo sapiens
VSSASMSLSREGSVSLAIAGVVLTSRTAAEADMDAAAGPPVSTRQSKSSLSGQHGRERTQASAEGCKEGRERREKDRALGRSSHRRRTGESRHKTRGDKIAQKSSSRSSFSHRANRDDKKEKGCGNPGSSRHRDSHKGVSHTPISKESRTSHKSGRSLWTTSSGSSKGLGRVSSFLRNVRANLTTKVVGTPHGRDVDVMAKMAERSTNVAIAETAEGGQGLEMVGSMTPDIMETVTFEAH

SEQ ID NO: 795084 - protein, 68 aa, Homo sapiens
GGRVLPSLGALAFLCLWSQESTPRADVRLLPMGPRAGMAQLLMALFFCVQDIKLPPIRSFNLFGAWIS

SEQ ID NO: 795085 - protein, 106 aa, Homo sapiens [sequence omitted]

SEQ ID NO: 795086 - protein, 115 aa, Homo sapiens
HPFLSSAEGNPPDASPLTHRSRSRLPPAPGPPENTASPHWSPPGNPTAHPRPALTLWGLHPLEEGRVKAWRCAACLTSAQGARQATGLSPDQRGPKGLIVKSAGPRTQGEDMLVL

SEQ ID NO: 795087 - protein, 40 aa, Homo sapiens
QQVVKKYELKLPYGGVKEMFLSREILESVIKTVKTFNSSK

SEQ ID NO: 795088 - protein, 42 aa, Homo sapiens
MGLGCHLQKLISSRTVCDGQMWNKTTGCIRRHCQGCKGLLHA

SEQ ID NO: 795089 - protein, 137 aa, Homo sapiens
MHGRAQKYTLGTAGPRVSDKVPGRDRAGVREPEPTLPLLQGGSGVHSLLEGVGSLWEWGQRLDSAHRRRPDSYCTAGSKPKGPPLARHSFLSVQNTPLEGEDRNHTLPWKEAEPRALSIPAAGELYTKSPTLQYLAL

SEQ ID NO: 795090 - protein, 80 aa, Homo sapiens
CWFSGSQLTPGLYAQALLHLLLLYGLVVSTALIWHPINKLAALLLLPYLAWLTVTSALTYHLWRDSLCPVHQPQPTEKSD

SEQ ID NO: 795091 - protein, 118 aa, Homo sapiens
PPCLHSYASYLVWKDLGGGLGWPLALPLGLYAVQLTISWTVLVLFFTVHNPGLALLHLLLLYGLVVSTALIWHPINKLAALLLLPYLAWLTVTSALTYHLWRDSLCPVHQPQPTEKSD

SEQ ID NO: 795092 - protein, 74 aa, Homo sapiens
EAPARAPRGGIYYESLAPSASFSSGLNSIRAAAARWLDQCRRGVEVSGVGKDSELQALEFAGIVNLQGEAVLIQ

SEQ ID NO: 795093 - protein, 120 aa, Homo sapiens
DPPLSTVAEEVGDVGEAAPPSVDVVGGFVSGTATTDGQACASAGARHKASNHVNRRRCSLPHVTNLLDTQHLPRKPIRQCWTTGSKLCKYPSTDTVLVPGIKVAASHHPPDRPPDPFSTL

SEQ ID NO: 795094 - protein, 105 aa, Homo sapiens
NINSLSSLCGQWTLSILPNSTFLKVCYRPSEFLLTSLAWLQGHKTNKFRWQDMFLSRYKKCNAVFVSCFCNLLPASRSSCLKMFTSRKSPLFGAQTFWTYVRLSW

SEQ ID NO: 795095 - protein, 44 aa, Homo sapiens [sequence omitted]

SEQ ID NO: 795096 - protein, 248 aa, Homo sapiens
MCNPWVAWLGVLPLFILLTQAALKPAMPPVIKSQPFNIFWAAPTMYCMPSFNVDINLQVFNIISNPLETQSGSKIAIFYPNELGYYPYLSQDGKSFNGGIPQNVSLSEHLRKTADDIGEGVPWWRSEELVVIDWESWKPQWDRNQGSRIIYKNHSLAFTRNHHPYWSEMKVETVAREEFENAGKNFMNITLTLALEMRPKCLWGFYLYPDCYNYDYRINPETYTGNCPNCGCGKKAQHFILQYIWIKY

SEQ ID NO: 795097 - protein, 66 aa, Homo sapiens
AGRHTSGWTSRGTHWQKKTQRLDLERALRGACRQKRTRGGRAHDKCQQAVERSRVWLGHLEKSLGR

SEQ ID NO: 795098 - protein, 72 aa, Homo sapiens
PGLFRGGYRRPGARVDKLELMFQKAESDLDYIQYRLEYEIKTNHPDSASELSPLTKEEKTAAEQFKFHMPDL

SEQ ID NO: 795099 - protein, 121 aa, Homo sapiens
MEAEVDKLELMFQKAESDLDYIQYRLEYEIKTNHPDSASEKNPVTLLKELSVIKSRYQTLYARFKPVAVEQKESKSRICATVKKTMNMIQKLQKQTDLELSPLTKEEKTAAEQFKFHMPDL

SEQ ID NO: 795100 - protein, 105 aa, Homo sapiens
MEAEVDKLELMAECKVKEIYWVVYFSPMASEVGHNLESPETPGGGGWTRVEFPPPAPKGAATVWCLNRLGSRKLSLIWITFNTGWNMKSRLIILIQQVRKIQLHS

SEQ ID NO: 795101 - protein, 121 aa, Homo sapiens; identical to SEQ ID NO: 795099

SEQ ID NO: 795102 - protein, 109 aa, Homo sapiens
MEAEVDKLELMFQKAESDLDYIQYRLEYEIKTNHPDSASEKNPVTLLKELSVIKSRYQTLYARFKPVAVEQKESKSRICATVKKTMNMIQKLQKQTDLEVMLSVDSCHH

SEQ ID NO: 795103 - protein, 105 aa, Homo sapiens; identical to SEQ ID NO: 795100

SEQ ID NO: 795104 - protein, 121 aa, Homo sapiens; identical to SEQ ID NO: 795099

SEQ ID NO: 795105 - protein, 72 aa, Homo sapiens; identical to SEQ ID NO: 795098

SEQ ID NO: 795106 - protein, 130 aa, Homo sapiens
SATLPFISFNELSSHQVKKRAGERRAQPYWDDAVPLLTPSWYGSDLCWQDFPLQCAQRVGVPSESVWFSSVLQRDAPRLMLTERADWAFLLKLSLKAGVTQSGVETDSYPCFSELSLKHIWLLYVTHFQI

SEQ ID NO: 795107 - protein, 538 aa, Homo sapiens
MALPYHIFLFTVLLPSFTLTAPPPCRCMTSSSPYQEFLWRMQRPGNIDAPSYRSLSKGTPTFTAHTHMPRNCYHSATLCMHANTHYWTGKMINPSCPGGLGVTVCWTYFTQTGMSDGGGVQDQAREKHVKEVISQLTRVHGTSSPYKGLDLSKLHETLRTHTRLVSLFNTTLTGLHEVSAQNPTNCWICLPLNFRPYVSIPVPEQWNNFSTEINTTSVLVGPLVSNLEITHTSNLTCVKFSNTTYTTNSQCIRWVTPPTQIVCLPSGIFFVCGTSAYRCLNGSSESMCFLSFLVPPMTIYTEQDLYSYVISKPRNKRVPILPFVIGAGVLGALGTGIGGITTSTQFYYKLSQELNGDMERVADSLVTLQDQLNSLAAVVLQNRRALDLLTAERGGTCLFLGEECCYYVNQSGIVTEKVKEIRDRIQRRAEELRNTGPWGLLSQWMPWILPFLGPLAAIILLLLFGPCIFNLLVNFVSSRIEAVKLQMEPKMQSKTKIYRRPLDRPASPRSDVNDIKGTPPEEISAAQPLLRPNSAGSS

SEQ ID NO: 795108 - protein, 76 aa, Homo sapiens [sequence omitted]

SEQ ID NO: 795109 - protein, 73 aa, Homo sapiens
TIDKDRIIDAGPKGNYSRFMNHSCQPNCETLKWTVSKGHIFEKSVKYSCQKEIQGQEKYYRVAIGNTEKCGKL

SEQ ID NO: 795110 - protein, 79 aa, Homo sapiens
GNKAVAAAAKWLKVQPKSGLFLSLGCGRLASTALGLQAACSLSSALTLTGAAFAGSSERLCNDPDPIQQRFKRKLVQGH

SEQ ID NO: 795111 - protein, 317 aa, Homo sapiens
MKRLSLVTTNRLSPQGNFLPLCTFPLAVDMAALFQEASSCPVCSDYLEKPMSLECGCTVCLKCINSLQKEPHGEDLLCCCCSMVSQRNKIRPNRQLERLVSHIKELEPKLKKILQMNPRMRKFQVDMTLDADTANNFLLISDDLRSVRSGLITQNRQDLAERFDVSVCILGSPRFTCGRHYWEVDVGTSTEWDLGVCRESVHCKGKIQLTTELGFWTVSLRDGSRLSASTVPLTFLLVDRKLQRVGIFLDMGMQNVSFFDAESGSHVYTFRSVSAEEPLRPFLAPSIPPNGDQGVLSICPLMNSGTTDAPVRPGEAK

SEQ ID NO: 795112 - protein, 67 aa, Homo sapiens
KEFLQLPSIEITPSSDEDTPWSNCSTPSASPRRKRFLLRKWLRVRERKECSEKQLKLADFHCTKLKI

SEQ ID NO: 795113 - protein, 134 aa, Homo sapiens
SETHPASGHTEGASFLVALAGMGCIGPGLILGKQLGIGSPLWKATPTSCTLSPGFLGWRHRLGQAGTCLGSAEPRSPAWEISSWVAHSWSTAAGEPALNSPHCRPGAMAHACNPSTLGGRDGRITRSGDRDHPG

SEQ ID NO: 795114 - protein, 102 aa, Homo sapiens
GPELSGSGGRPSTEALQQGLGEQKGRPCNSGWEYRTLCLGPELLPVPAPSAHPSLIIWLLGTVDFPECSGLLGTPLTVGEDSVNKGAPWVGAVVTSCGKSPG

SEQ ID NO: 795115 - protein, 539 aa, Homo sapiens
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATEWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKRCVHRTVSVYV

SEQ ID NO: 795116 - protein, 645 aa, Homo sapiens
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATEWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEVRVNVCVSMHIVCGGEWAVSSASLPEPTIYGRKSPWAPTESSELFRMSYLAPVGHIHHSRQLVSAAMSISIPPLQMGGIERGGGRVLCPIEITEPTLMLQPHLLPYQAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKRDGAKERTSI

SEQ ID NO: 795117 - protein, 744 aa, Homo sapiens
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATESQVGIYIIHLEVECRWRQSPWEAAGRGLPWEEAEAAGLGRDKVSYSPSWRESLGGLLSGMEVPEWQSSPQKAPGSGEEELVPAGEGLMFIGGPFLPVLQWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEVRVNVCVSMHIVCGGEWAVSSASLPEPTIYGRKSPWAPTESSELFRMSYLAPVGHIHHSRQLVSAAMSISIPPLQMGGIERGGGRVLCPIEITYPTLMLQPHLLPYQAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKRDGAKERTSI

SEQ ID NO: 795118 - protein, 233 aa, Homo sapiens
MLQPHLLPYQAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKRDGAKERTSI

SEQ ID NO: 795119 - protein, 516 aa, Homo sapiens
MEWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEVRVNVCVSMHIVCGGEWAVSSASLPEPTIYGRKSPWAPTESSELFRMSYLAPVGHIHHSRQLVSAAMSISIPPLQMGGIERGGGRVLCPIEITEPTLMLQPHLLPYQAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKRDGAKERTSI

SEQ ID NO: 795120 - protein, 563 aa, Homo sapiens
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATEWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEVRVNVCVSMHIVCGGEWAVSSASLPEPTIYGRKSPWAPTESSELFRMSYLAPVGHIHHSRQLVSAAMSISIPPLQMGGIERGGGRVLCPIEITEPTLMLQPHLLPYQAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSGEPSPIGSAHPRSRARNPAHSPETPPPGQEPTP

SEQ ID NO: 795121 - protein, 118 aa, Homo sapiens
PPSGTETPFRFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLR

SEQ ID NO: 795122 - protein, 460 aa, Homo sapiens
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATEWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLR

SEQ ID NO: 795123 - protein, 152 aa, Homo sapiens
SQNQQASQHSSKCPVSTLGFSQQTNNESEEKQSTKGSMMRTIIKEWLRPGSFLSHCVGIPSLWPLRSPGQEPHLSTVAEHSEAWGLPHRCAPIPRLECAGCMSPPTHGDFRAPLRRRDSGWEEIPQGFCDVDSALFLHLAGSDTGLCFPISC

SEQ ID NO: 795124 - protein, 38 aa, Homo sapiens
MHHQAQLIFVFLVETGFHHVGQAGLELLTSGDPPTLAS

SEQ ID NO: 795125 - protein, 102 aa, Homo sapiens
PPLNQPPGGKALSTRALQPGGALEAGTRGGREGHRRLRQPPTPSAPPGSPLHEGFLLIALFPSSQNRHRSAGRGLAGRLQQVRPGAAGPRGFLRSCIYFTSM

SEQ ID NO: 795126 - protein, 102 aa, Homo sapiens; identical to SEQ ID NO: 795125

SEQ ID NO: 795127 - protein, 113 aa, Homo sapiens
PAAQSPPPAERPGRDAAGARVCGTQRGGCARAAEAPQPTGGRGCSRGSATASGVGGKAIKKAQRIPAELYLLYIHVNCCHHYCVQAQRMNWKRREGENNKKRKLVFTTHSKPE

SEQ ID NO: 795128 - protein, 102 aa, Homo sapiens; identical to SEQ ID NO: 795125

SEQ ID NO: 795129 - protein, 94 aa, Homo sapiens
WVWLSCPGQGPLRAAEPSLQLEHRRPAPSLCRFFLRDLGWSRHCPGLYSGEACLLSSHQPFVTPCPQAGIKFMPTDLSLSLGLSPPAQGRPDAG

SEQ ID NO: 795130 - protein, 64 aa, Homo sapiens
KQQVALGGQFPMTAPQHRLGDPHVVISITRGMTPVGLGQLSPHLSSLLMDLFVSRDLINSFLFR

SEQ ID NO: 795131 - protein, 93 aa, Homo sapiens
PEPVWRALYHWYGANLALPRPVIKNSKTDIPELELFPRYLLFLRQQPAYILFYEQQGIDYAQFLPKTDGKKMADTSSMDEDFESDYKKYCVLQ

SEQ ID NO: 795132 - protein, 95 aa, Homo sapiens
EVSAFGEEGEGDYLDDWTVLCNGPYWVRDGEVRFKHSSTEVLLSVTGEQYGRPISGQKEVHGMAQPSQNNYWKAMEGIFMKPSELLKAEAHHAEL

SEQ ID NO: 795133 - protein, 89 aa, Homo sapiens
ECSPLDSASLGAECSPLDAVRLGAECSRLDAVSLGAECSLLDSLRLGAGSFGVCCAGRPFLSPAPGAAFASSKPPQALCGVSEMQVQRL

SEQ ID NO: 795134 - protein, 90 aa, Homo sapiens
LWAKRSLCGRVWKSHGWVLDLQDDSGEKGRPSLRSWSQDLLFSFGLSSPFEKVTFSNPCQLCLVLERPQQECLTLGEVWGKISKHINIEN

SEQ ID NO: 795135 - protein, 353 aa, Homo sapiens
MNECHYDKHMDFFYNRSNTDTVDDWTGTKLVIVLCVGTFFCLFIFFSNSLVIAAVIKNRKFHFPFYYLLANLAAADFFAGIAYVFLMFNTGPVSKTLTVNRWFLRQGLLDSSLTASLTNLLVIAVERHMSIMRMRVHSNLTKKRVTLLILLVWAIAIFMGAVPTLGWNCLCNISACSSLAPIYSRSYLVFWTVSNLMAFLIMVVVYLRIYVYVKRKTNVLSPHTSGSISRRRTPMKLMKTVMTVLGAFVVCWTPGLVVLLLDGLNCRQCGVQHVKRWFLLLALLNSVVNPIIYSYKDEDMYGTMKKMICCFSQENPERRPSRIPSTVLSRSDTGSQYIEDSISQGAVCNKSTS

SEQ ID NO: 795136 - protein, 305 aa, Homo sapiens
MNECHYDKHMDFFYNRSNTDTVDDWTGTKLVIVLCVGTFFCLFIFFSNSLVIAAVIKNRKFHFPFYYLLANLAAADFFAGIAYVFLMFNTGPVSKTLTVNRWFLRQGLLDSSLTASLTNLLVIAVERHMSIMRMRVHSNLTKKKVSNLMAFLIMVVVYLRIYVYVKRKTNVLSPHTSGSISRRRTPMKLMKTVMTVLGAFVVCWTPGLVVLLLDGLNCRQCGVQHVKRWFLLLALLNSVVNPIIYSYKDEDMYGTMKKMICCFSQENPERRPSRIPSTVLSRSDTGSQYIEDSISQGAVCNKSTS

SEQ ID NO: 795137 - protein, 2156 aa, Homo sapiens
MSDTPSTGFSIIHPTSSEGQVPPPRHLSLTHPVVAKRISFYKSGDPQFGGVRVVVNPRSFKSFDALLDNLSRKVPLPFGVRNISTPRGRHSITRLEELEDGESYLCSHGRKVQPVDLDKARRRPRPWLSSRAISAHSPPHPVAVAAPGMPRPPRSLVVFRNGDPKTRRAVLLSRRVTQSFEAFLQHLTEVMQRPVVKLYATDGRRVPSLQAVILSSGAVVAAGREPFKPGNYDIQKYLLPARLPGISQRVYPKGNAKSESRKISTHMSSSSRSQIYSVSSEKTHNNDCYLDYSFVPEKYLALEKNDSQNLPIYPSEDDIEKSIIFNQDGTMTVEMKVRFRIKEEETIKWTTTVSKTGPSNNDEKSEMSFPGRTESRSSGLKLAACSFSADVSPMERSSNQEGSLAEEINIQMTDQVAETCSSASWENATVDTDIIQGTQDQAKHRFYRPPTPGLRRVRQKKSVIGSVTLVSETEVQEKMIGQFSYSEERESGENKSEYHMFTHSCSKMSSVSNKPVLVQINNNDQMEESSLERKKENSLLKSSAISAGVIEITSQKMLEMSHNNGLPSTISNNSIVEEDVVDCVVLDNKTGIKNFKTYGNTNDRFSPISADATHFSSNNSGTDKNISEAPASEASSTVTARIDRLINEFAQCGLTKLPKNEKKILSSVASKKKKKSRQQAINSRYQDGQLATKGILNKNERINTKGRITKEMIVQDSDSPLKGGILCEEDLQKSDTVIESNTFCSKSNLNSTISKNFHRNKLNTTQNSKVQGLLTKRKSRSLNKISLGAPKKREIGQRDKVFPHNESKYCKSTFENKSLFHVFNILEQKPKDFYAPQSQAEVASGYLRGMAKKSLVSKVTDSHITLKSQKKRKGDKVKASAILSKQHATTRANSLASLKKPDFPEAIAHHSIQNYIQSWLQNINPYPTLKPIKSAPVCRNETSVVNCSNNSFSGNDPHTNSGKISNFVMESNKHITKIAGLTGDNLCKEGDKSFIANDTGEEDLHETQVGSLNDAYLVPLHEHCTLSQSAINDHNTKSHIAAEKSGPEKKLVYQEINLARKRQSVEAAIQVDPIEEETPKDLLPVLMLHQLQASVPGIHKTQNGVVQMPGSLAGVPFHSAICNSSTNLLLAWLLVLNLKGSMNSFCQVDAHKATNKSSETLALLEILKHIAITEEADDLKAAVANLVESTTSHFGLSEKEQDMVPIDLSANCSTVNIQSVPKCSENERTQGISSLDGGCSASEACAPEVCVLEVTCSPCEMCTVNKAYSPKETCNPSDTFFPSDGYGVDQTSMNKACFLGEVCSLTDTVFSDKACAQKENHTYEGACPIDETYVPVNVCNTIDFLNSKENTYTDNLDSTEELERGDDIQKDLNILTDPEYKNGFNTLVSHQNVSNLSSCGLCLSEKEAELDKKHSSLDDFENCSLRKFQDENAYTSFDMEEPRTSEEPGSITNSMTSSERNISELESFEELENHDTDIFNTVVNGGEQATEELIQEEVEASKTLELIDISSKNIMEEKRMNGIIYEIISKRLATPPSLDFCYDSKQNSEKETNEGETKMVKMMVKTMETGSYSESSPDLKKCIKSPVTSDWSDYRPDSDSEQPYKTSSDDPNDSGELTQEKEYNIGFVKRAIEKLYGKADIIKPSFFPGSTRKSQVCPYNSVEFQCSRKASLYDSEGQSFGSSEQVSSSSSMLQEFQEERQDKCDVSAVRDNYCRGDIVEPGTKQNDDSRILTDIEEGVLIDKGKWLLKENHLLRMSSENPGMCGNADTTSVDTLLDNNSSEVPYSHFGNLAPGPTMDELSSSELEELTQPLELKCNYFNMPHGSDSEPFHEDLLDVRNETCAKERIANHHTEEKGSHQSERVCTSVTHSFISAGNKVYPVSDDAIKNQPLPGSNMIHGTLQEADSLDKLYALCGQHCPILTVIIQPMNEEDRGFAYRKESDIENFLGFYLWMKIHPYLLQTDKNVFREENNKASMRQNLIDNAIGDIFDQFYFSNTFDLMGKRRKQKRINFLGLEEEGNLKKFQPDLKERFCMNFLHTSLLVVGNVDSNTQDLSGQTNEIFKAVDENNNLLNNRFQGSRTNLNQVVRENINCHYFFEMLGQACLLDICQVETSLNISNRNILELCMFEGENLFIWEEEDILNLTDLESSREQEDL

SEQ ID NO: 795138 - protein, 2156 aa, Homo sapiens; identical to SEQ ID NO: 795137

SEQ ID NO: 795139 - protein, 553 aa, Homo sapiens
MKLGSSRAGPGRGSAGLLPGVHELPMGIPAPWGTSPLSFHRKCSLWAPGRPFLTLVLLVSIKQVTGSLLEETTRKWAQYKQACLRDLLKEPSGIFCNGTFDQYVCWPHSSPGNVSVPCPSYLPWWSEESSGRAYRHCLAQGTWQTIENATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEESEI

SEQ ID NO: 795140 - protein, 421 aa, Homo sapiens
SWYPELMDIRQTRPLRATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEESEI

SEQ ID NO: 795141 - protein, 47 aa, Homo sapiens
PGPRAGSTSTLLTKLPLPSYGCRKPLDASLSLPLHTWYAVSTTLIPQ

SEQ ID NO: 795142 - protein, 425 aa, Homo sapiens
AAVVTALEDVFQALGFESCERREVPVQGFLEELAWFQEQLDAHGRPVGCALVALMPPEEQLRQPQQLVRELSGCRALRGCPKVFLLLSSGPGSSLEPGAFLAGLRELCGRSPHWSLVQLLTKLFRRVAEESAGGTCCPVLRSSLRGALCLGGVEPWRPEPAPGPSTQYDLSKARAALLLAVIQGRPGAQHDVEALGGLCWALGFETTVRTDPTAQAFQEELAQFREQLDTCRGPVSCALVALMAHGGPRGQLLGADGQEVQPEALMQELSRCQVLQGRPKIFLLQACRGGNRDAGVGPTALPWYWSWLRAPPSVPSHADVLQIYAEAQGSSCRGTPPGSSDQADILTVYSAAEGYVAYRDDKGSDFIQTLVEVLRANPGRDLLELLTEVNRRVCEQEVLGPDCDELRKACLEIRSSLRRRLCLQA

SEQ ID NO: 795143 - protein, 272 aa, Homo sapiens
AAVVTALEDVFQALGFESCERREVPVQGFLEELAWFQEQLDAHGRPVGCALVALMPPEEQLRQPQQLVRELSGCRALRGCPKVFLLLSSGPGSSLEPGAFLAGLRELCGRSPHWSLVQLLTKLFRRVAEESAGGTCCPVLRSSLRGALCLGGVEPWRPEVRGAGQGSNHMATVSSGTEAKGGPRRGGQELESSQATLDVSEPSLQPAPGPSTQYDLSKARAALLLAVIQGRPGAQHDVEALGGLCWALGFETTVRTDPTAQVRGSRELPLVL

SEQ ID NO: 795144 - protein, 98 aa, Homo sapiens
SAVGCSTRDTVLSRERGLSFHQFPTDTIQRSKWIRAVNRVDPRSKKIWIPGPGAILCSKHFQESDFESYGIRRKLKKGAVPSVSLYKIPQGVHLKGKA

SEQ ID NO: 795145 - protein, 109 aa, Homo sapiens
SVLGGSATTRTVRTRPATATHDDVTSGTPKEKKAQTSKKKQSSMAKAERQASPADLPIDPSEPSYWEMIRCDNECPIEWFRFSCVSLNHKPKRKWYCSRCRGKNDGQSP

SEQ ID NO: 795146 - protein, 135 aa, Homo sapiens
MPNSPCRDPPCAGMPNSPCRDPPCAEPWTGLSLPDTAQSWSSPLGLLGRLRNKRPSVQTPPDPILEPSFSLCSPMDPSASSPGPGRGRIYAGTACTDIVWVSEAGVTLGCWTWGACSYGGGCQPSPPRIADSTWT

SEQ ID NO: 795147 - protein, 269 aa, Homo sapiens
MLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGNDIALIKLSRSAQLGDAVQLASLPPAGDILPNKTPCYITGWGRLYTNGPLPDKLQQARLPVVDYKHCSRWNWWGSTVKKTMVCAGGYIRSGCNGDSGGPLNCPTEDGGWQVHGVTSFVSGFGCNFIWKPTVFTRVSAFIDWIEETIASH

SEQ ID NO: 795148 - protein, 263 aa, Homo sapiens
TALLSPLASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGNDIALIKLSRSAQLGDAVQLASLPPAGDILPNKTPCYITGWGRLYTNGPLPDKLQQARLPVVDYKHCSRWNWWGSTVKKTMVCAGGYIRSGCNGDSGGPLNCPTEDGGWQVHGVTSFVSGFGCNFIWKPTVFTRVSAFIDWIEETIASH

SEQ ID NO: 795149 - protein, 137 aa, Homo sapiens
PFQGLPLNSLPRWVIFPNKNNPGNITGLGAVFYTNGPLPDKLQQARLPVVDYKHCSRWNWWGSTVKKTMVCAGGYIRSGCNGDSGGPLNCPTEDGGWQVHGVTSFVSGFGCNFIWKPTVFTRVSAFIDWIEETIASH

SEQ ID NO: 795150 - protein, 178 aa, Homo sapiens
MLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGNDIALIKLSRSAQLGDAVQLASLPPAGDILPNKTSCSRPGCPWWTISTAPGGTGGVPP

SEQ ID NO: 795151 - protein, 69 aa, Homo sapiens
CPIITKLMMLRLLSSLLLVAVASGYGPPSSHRGWWLAGPRCDQLCFWLWLQLHLEAHGVHSSLRLHRLD

SEQ ID NO: 795152 - protein, 269 aa, Homo sapiens; identical to SEQ ID NO: 795147

SEQ ID NO: 795153 - protein, 265 aa, Homo sapiens
MLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGNDIALIKLSRSAQLGDAVQLASLPPAGDILPNKTPCYITGWGRLYTNGPLPDKLQQARLPVVDYKHCSRWNWWGSTVKKTMVCAGGYIRSGCNGDSGGPLNCPTEDGGWQVHGVTSFVSGFGCNFIWKPTVFTRVSAFIDWIEET

SEQ ID NO: 795154 - protein, 266 aa, Homo sapiens
MLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGNDIALIKLSRSAQLGDAVQLASLPPAGDILPNKTPCYITGWGRLYTNGPLPDKLQQARLPVVDYKHCSRWNWWGSTVKKTMVCAGGYIRSGCNGDSGGPLNCPTEDGGWQVHGVTSFVSGFGCNFIWKPTVFTRVSAFIDWIEEGG

SEQ ID NO: 795155 - protein, 140 aa, Homo sapiens
MLRLLSSLLLVAVASGYGPPSSHSSSRVVHGEDAVPYSWPWQVSLQYEKSGSFYHTCGGSLIAPDWVVTAGHCISRDLTYQVVLGEYNLAVKEGPEQVIPINSEELFVHPLWNRSCVACGVTLEDPSTAPQRMVAGRSTV

SEQ ID NO: 795156 - protein, 75 aa, Homo sapiens
GRASVPLLRWFRSPSLASPRVLLPASEEGPQSASGVRVVGIPGRITKSLKWDLPNAFLSAHFRSRLTNVLETCCY

SEQ ID NO: 795157 - protein, 102 aa, Homo sapiens
LGSRNVTVGGMKGWNLELDSLRCRSGQHRHRQFHPRLAVQAVHDAGPVARFPYRVQSQLTPPLRRTSTKEGKERQRHRCPPHGRITSSSDEGGGFKLQLCLR

SEQ ID NO: 795158 - protein, 106 aa, Homo sapiens
QAGEVVYHIAAVAVVYNRQQHSQRLYLGHDDDILSLTIHPVKDYVATGQVGRDAAIHVWDTQTLKCLSLLKGQHQRGVCALDFSADGKCLVSVGLDDFHSIVFWDW

SEQ ID NO: 795159 - protein, 104 aa, Homo sapiens
MQTASNSKQVTAHGVLAKDISYRKETGSYGLDFPTLTDPQDKTTGSCQPLEKSQNTQPWHVNTLHRSEAAGHTDSPSHRLVFHKHVLVSRADGGEVHFLPDIFV

SEQ ID NO: 795160 - protein, 702 aa, Homo sapiens
MTSRNQLVQKVLQELQEAVECEGLEGLIGASLEAKQVLSSFTLPTCREGGPGLQVLEVDSVALSLYPEDAPRNMLPLVCKGEGSLLFEAASMLLWGDAGLSLELRARTVVEMLLHRHYYLQGMIDSKVMLQAVRYSLCSEESPEMTSLPPATLEAIFDADVKASCFPSSFSNVWHLYALASVLQRNIYSIYPMRNLKIRPYFNRVIRPRRCDHVPSTLHIMWAGQPLTSHFFRHQYFAPVVGLEEVEAEGAPGVAPALPALAPLSSPAKTLELLNREPGLSYSHLCERYSVTKSTFYRWRRQSQEHRQKVAARFSAKHFLQDSFHRGGVVPLQQFLQRFPEISRSTYYAWKHELLGSGTCPALPPREVLGMEELEKLPEEQVAEEELECSALAVSSPGMVLMQRAKLYLEHCISLNTLVPYRCFKRRFPGISRSTYYNWRRKALRRNPSFKPAPALSAAGTPQLASVGEGAVIPWKSEAEEGAGNATGEDPPAPGELLPLRMPLSRWQRRLRRAARRQVLSGHLPFCRFRLRYPSLSPSAFWVWKSLARGWPRGLSKLQVPVPTLGKGGQEAEEKQEKEAGRDVTAVMAPPVGASSEDVEGGPSREGALQEGATAQGQPHSGPLLSQPVVAAAGGRDGRMLVMDMIATTKFKAQAKLFLQKRFQSKSFPSYKEFSALFPLTARSTYYMWKRALYDGLTLVDG

SEQ ID NO: 795161 - protein, 241 aa, Homo sapiens
MTSRNQLVQKVLQELQEAVECEGLEGLIGASLEAKQVLSSFTLPTCREGGPGLQVLEVDSVALSLYPEDAPRNMLPLVCKGEGSLLFEAASMLLWGDAGLSLELRARTVVEMLLHRHYYLQGMIDSKVMLQAVRYSLCSEESPEMTSLPPATLEAIFDADVKASCFPSSFSNVWHLYALASVLQRNIYSIYPMRNLKIRPYFNRVIRPRRCDHVPSTLHIMWAGQPYSIFAHLAWAMTKAL

SEQ ID NO: 795162 - protein, 177 aa, Homo sapiens
MCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 795163 - protein, 354 aa, Homo sapiens
MAEVLRTLAGKPKCHALRPMILFLIMLVLVLFGYGFLSPRSLMPGSLERGFCMAVREPDHLQHVSLPRMVYPQSKVLTPCRKDVLVVPLGWLPIVWEGTFNIDILNEQFRLQNTTIGLTVFAIKKYVAFLKLFLETAEKHFMVGHRVHYYVFTDQPAAVPRVTLGTGRQLSVLEVRAYKRWQDVSMRRMEMISDFCERRFLSEVDYLVCVDVDMEIRDHVGVEILTPLFGTLHPGFYGSSREAFTYERRPQSQAYIPKDEGDFYYLGGFFGGSVQEMQRLTRACHQAMMVDQANGIEAVWHDESHLNKYLLRHKPTKVLSPEYLWDQQLLGWPAVLRKLRFTAVPKNHQAVRNP

SEQ ID NO: 795164 - protein, 117 aa, Homo sapiens
ALENANTNTEVLKNMGSAAKAKKRAHDNMDIDKVDELMQDIADQQELGEEISTAISKPVGFGEKSDEDELMAELEELEQEEPDKNLLEVSGPETVPLPNVPSIALPSKPAKKRKTTT

SEQ ID NO: 795165 - protein, 165 aa, Homo sapiens
RGRGGWGVGGREGAGTPGSGAGAGGAGTGDPGGGGGGRGKPRGRSCGCGARGPERPPSPERETVRTATPFPMVSLFLVFTAFVISNIGHIRPQRTILAFVSGIFFILSGLSLVVGLVLYISSINDEVMNRPSSSEQYFHYRYGWSFAFAASSFLLKEVTSVGPRL

SEQ ID NO: 795166 - protein, 269 aa, Homo sapiens
RGRGGWGVGGREGAGTPGSGAGAGGAGTGDPGGGGGGRGKPRGRSCGCGARGPERPPSPERGPAGRPLPLRMSHCSSRALTLLSSVFGACGLLLVGIAVSTDYWLYMEEGTVLPQNQTTEVKMALHAGLWRVCFFAGREKGRCVASEYFLEPEINLVTENTENILKTVRTATPFPMVSLFLVFTAFVISNIGHIRPQRTILAFVSGIFFILSGLSLVVGLVLYISSINDEVMNRPSSSEQYFHYRYGWSFAFAASSFLLKEVTSVGPRL

SEQ ID NO: 795167 - protein, 61 aa, Homo sapiens
LLSQGFGLTALPPPGCCPQSPWKCCIHICAYSSQQRVEPKTKPWKDQDPQPVRISVFWLET

SEQ ID NO: 795168 - protein, 110 aa, Homo sapiens
MLPPGEPPRGLALQMKAAGCRESVTGLAMELGCSCLGGVCDWLAGELCSLEALGRHCCPPGSAMPGGGRWGGRGLGVCLKLQGTVLRPMLTTDHVSSSPEITLGPTLGRL

SEQ ID NO: 795169 - protein, 383 aa, Homo sapiens
MLENYNSIVSLGLPVPQPDVIFQLKRGDKPWMVDLHGSEEREWPESVSLDWETKPEIHDASDKKSEGSLRECLGRQSPLCPKFEVHTPNGRMGTEKQSPSGETRKKSLSRDKGLRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 795170 - protein, 207 aa, Homo sapiens
GSVSGFPALITFEMGPGNQPSGGGATEPCQKAPLKKVIWKIFRNLAILGLLVSKPYVICQLEEGGEPFMVEREISTGAHSDWKRRSKSKESMPSWGISKEELFQVVSVEKHIQDVLQFSKLKAACGCDGQLKMQQIKQERHLKQMSTIHKSATTLSRDYKWNGFGKSLGLRSALVNQPSILMGKGSYKCDTEFRQPLGGNNSQRTPP

SEQ ID NO: 795171 - protein, 425 aa, Homo sapiens
MAAVSPTTRCQESVTFEDVAVVFTDEEWSRLVPIQRDLYKEVMLENYNSIVSLGLPVPQPDVIFQLKRGDKPWMVDLHGSEEREWPESVSLDWETKPEIHDASDKKSEGSLRECLGRQSPLCPKFEVHTPNGRMGTEKQSPSGETRKKSLSRDKGLRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 795172 - protein, 237 aa, Homo sapiens
LFHAHKMPSKRNNPRAASSQSIMIKVLDGSDSLDGDPDLMTFEDVAVEFSQWEWGQLNPAQKDLYKEVMLENFRNLAILGLLVSKPYVICQLEEGGEPFMVEREISTGAHSDWKRRSKSKESMPSWGISKEELFQVVSVEKHIQDVLQFSKLKAACGCDGQLKMQQIKQERHLKQMSTIHKSATTLSRDYKWNGFGKSLGLRSALVNQPSILMGKGSYKCDTEFRQPLGGNNSQRTP

SEQ ID NO: 795173 - protein, 316 aa, Homo sapiens
KNEFLTEQLSKTQIKLNTLKDKFRKTRDTLRKKIIGFRNSPNDLSQTQQQIKEMKEMYENAEDKVNNSTGKWSCVEERICHLQHENPCLEQQLDDVHQKEDHKEIVTNIQRGFIESRKKDLMLEEKSKKLMNECDHLKESLFQYEREKAERVVVVDNFNKKRLTALKKLTMLESPLEGISRCHINLVETQVPKKKLFQVESQFDDLMAEKEAVSSKCVNLAKENQVFQQELLSMKKVQQECEKLEEDKKMLEEEILNLKTHMENSMVELSKLQEYKSELDERAMQAVEKLEEIHLQEQAQYKKQLEQLNKDIIQLH

SEQ ID NO: 795174 - protein, 74 aa, Homo sapiens
EEDAQSVKKEMGMGNRAPEGYQAVRSQVGGAENASIATRRGTTVSGKLAHGEGDIHSSHCPLSLLSQGESTPVM

SEQ ID NO: 795175 - protein, 53 aa, Homo sapiens
MSQQKMARALVATCRGINRGTSSAISGNQEWLRVPHRVRAGLWSQIKKQGRPR

SEQ ID NO: 795176 - protein, 110 aa, Homo sapiens
GLRAAQGESLRPPAPASLHVGGPKPAAKSAKSFPRRLRDRKCLGPGGGRTRVAASALSLGSVPLPAFLPRPSPWQLGRRERGLRAEWVGEPPGSIRQPTRSDEGAPLKEN

SEQ ID NO: 795177 - protein, 101 aa, Homo sapiens
GLRAAQGESLRPPAPASLHVGGPKPAAKSAKSFPRRLRDRKCLGPGGGRTRVAASALSLGSTIEGELDKLESTEMRLLGMALVPHPEQGWPMEWGEDSGGA

SEQ ID NO: 795178 - protein, 117 aa, Homo sapiens
SPRGAAEVRGNRVEQDVDLDLSLALPLPTPSSCLDRGRKGRLHSGLRPGWASCPKHKDWDLALWAHPVIQQTLIGRARWLPPVILILWEAKAGGSPELRNLRPAWPTWQNTISTEKK

SEQ ID NO: 795179 - protein, 390 aa, Homo sapiens
MGQRLSGGRSCLDVPGRLLPQPPPPPPPVRRKLALLFAMLCVWLYMFLYSCAGSCAAAPGLLLLGSGSRAAHDPPALATAPDGTPPRLPFRAPPATPLASGKEMAEGAASPEEQSPEVPDSPSPISSFFSGSGSKQLPQAIIIGVKKGGTRALLEFLRVHPDVRAVGAEPHFFDRSYDKGLAWYRDLMPRTLDGQITMEKTPSYFVTREAPARISAMSKDTKLIVVVRDPVTRAISDYTQTLSKRPDIPTFESLTFKNRTAGLIDTSWSAIQIGIYAKHLEHWLRHFPIRQMLFVSGERLISDPAGELGRVQDFLGLKRIITDKHFYFNKTKGFPCLKKAEGSSRPHCLGKTKGRTHPEIDREVVRRLREFYRPFNLKFYQMTGHDFGWD

SEQ ID NO: 795180 - protein, 390 aa, Homo sapiens; identical to SEQ ID NO: 795179

SEQ ID NO: 795181 - protein, 99 aa, Homo sapiens
SKLIPASCRFSAGRKPALLTAPWSLEEATLCCWRMAWDTEAPALARLHVRGDPCVPSSAHDGSRTRECLGTTGSWHQLRRGCRGPWVTRDPCPSELPDG

SEQ ID NO: 795182 - protein, 437 aa, Homo sapiens
MDGNDNVTLLFAPLLRDNYTLAPNASSLGPGTDLALAPASSAGPGPGLSLGPGPSFGFSPGPTPTPEPTTSGLAGGAASHGPSPFPRPWAPHALPFWDTPLNHGLNVFVGAALCITMLGLGCTVDVNHFGAHVRRPVGALLAALCQFGLLPLLAFLLALAFKLDEVAAVAVLLCGCCPGGNLSNLMSLLVDGDMNLSIIMTISSTLLALVLMPLCLWIYSWAWINTPIVQLLPLGTVTLTLCSTLIPIGLGVFIRYKYSRVADYIVKVSLWSLLVTLVVLFIMTGTMLGPELLASIPAAVYVIAIFMPLAGYASGYGLATLFHLPPNCKRTVCLETGSQNVQLCTAILKLAFPPQFIGSMYMFPLLYALFQSAEAGIFVLIYKMYGSEMLHKRDPLDEDEDTDISYKKLKEEEMADTSYGTVKAENIIMMETAQTSL

SEQ ID NO: 795183 - protein, 437 aa, Homo sapiens; identical to SEQ ID NO: 795182

SEQ ID NO: 795184 - protein, 292 aa, Homo sapiens
MALAALMIALGSLGLHTWQAQAVPTILPLGLAPDTFDDTYVGCAEEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGNATLFSLTTCFGAPIQAFSVFPKEREVLIPPHEVFLVTRFSQDGAQSLVTLWSYNQTCSHFNCAYLGGEKRRGCVSAPGALGTGDLHMTKRHLQQP

SEQ ID NO: 795185 - protein, 331 aa, Homo sapiens
QLASRTFAFSRTPDSSGDSAAPARALGAPSRWRPPQPSRMALAALMIALGSLGLHTWQAQAVPTILPLGLAPDTFDDTYVGCAEEMEEKAAPLLKEEMAHHALLRESWEAAQETWEDKRRGLTLPPGFKAQNGIAIMVYTNSSNTLYWELNQAVRTGGGSRELYMRHFPFKALHFYLIRALQLLRGSGGCSRGPGEVVFRGVGSLRFEPKRLGDSVRLGQFASSSLDKAVAHRFGNATLFSLTTCFGAPIQAFSVFPKEREVLIPPHEVFLVTRFSQDGAQSLVTLWSYNQTCSHFNCAYLGGEKRRGCVSAPGALGTGDLHMTKRHLQQP

SEQ ID NO: 795186 - protein, 126 aa, Homo sapiens
WALFHQLCILPDRNWTYIHSIIPREQKLLEGRGHLISLVLPDAAQLPLSTEIWREDIWGHRPFLKPIFHEAFLNSPKLTFPSSSECHRHDPCDSSPCIVISGFYLLPGYLPFQNMRLVTHEGKAHG

SEQ ID NO: 795187 - protein, 1073 aa, Homo sapiens
KSSVVPPRGTRRGEKSDQDKSGQKNKRDFLSMKQSPALAPEERYRRAGSPKPVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGERIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 795188 - protein, 125 aa, Homo sapiens
MLRIKCHCKITSLYVECRKITTADVNEKNLLSCCKNQCPKELPCGHRCKEMCHPGECPFNCNQKVKLRCPCKRIKKELQCNKVRENQVSIECDTTCKEMKRKASEIKEAEAKAALEEEKRRQQVN

SEQ ID NO: 795189 - protein, 245 aa, Homo sapiens
ILDCQNHTCMKECHKVTKTDGCTGKNKAGPECLHCEEGCSKSRPLGCLHPCILRCHPGECPPCVQMLRIKCHCKITSLYVECRKITTADVNEKNLLSCCKNQCPKELPCGHRCKEMCHPGECPFNCNQKVKLRCPCKRIKKELQCNKVRENQVSIECDTTCKEMKRKASEIKEAEAKAALEEEKRRQQAELEAFENRLKGRRKKNRKRDEVAVELSLWQKHKYYLISVCGVVVVVFAWYITHDVN

SEQ ID NO: 795190 - protein, 245 aa, Homo sapiens; identical to SEQ ID NO: 795189

SEQ ID NO: 795191 - protein, 529 aa, Homo sapiens
MFVHSSTNRQHTRKSFRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 795192 - protein, 926 aa, Homo sapiens
ILDCQNHTCMKECHKVTKTDGCTGKNKAGPECLHCEEGCSKSRPLGCLHPCILRCHPGECPPCVQMLRIKCHCKITSLYVECRKITTADVNEKNLLSCCKNQCPKELPCGHRCKEMCHPGECPFNCNQKVKLRCPCKRIKKELQCNKVRENQVSIECDTTCKEMKRKASEIKEAEAKAALEEEKRRQQAELEAFENRLKGRRKKNRKRDEVAVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGERIPPCRALCEHSKERCESVLGIVGLQWPEDTDCSQFPEENSDNQTCLMPDEYVEGCKERDLWECPSNKQCLKHTVICDGFPDCPDYMDEKNCSFCQDDELECANHACVSRDLWCDGEADCSDSSDEWDCGELLVSAICCTLSCLSATEAEWILNYFLDFTDQVHLFCFTVIKADSADLCVLFPTHRKFPHEATSLFEISILYGKTFGFKML

SEQ ID NO: 795193 - protein, 262 aa, Homo sapiens
ILDCQNHTCMKECHKVTKTDGCTGKNKAGPECLHCEEGCSKSRPLGCLHPCILRCHPGECPPCVQMLRIKCHCKITSLYVECRKITTADVNEKNLLSCCKNQCPKELPCGHRCKEMCHPGECPFNCNQKVKLRCPCKRIKKELQCNKVRENQVSIECDTTCKEMKRKASEIKEAEAKAALEEEKRRQQAELEAFENRLKGRRKKNRKRDEVAVLRADDNNMGNGCSQKLATANLLRFLLLVLIPCICALVLLLVILLSYVGG

SEQ ID NO: 795194 - protein, 222 aa, Homo sapiens
MFVHSSTNRQHTRKSFRALCEHSKERCESVLGIVGLQWPEDTDCSQFPEENSDNQTCLMPDEYVEGCKERDLWECPSNKQCLKHTVICDGFPDCPDYMDEKNCSFCQDDELECANHACVSRDLWCDGEADCSDSSDEWDCGELLVSAICCTLSCLSATEAEWILNYFLDFTDQVHLFCFTVIKADSADLCVLFPTHRKFPHEATSLFEISILYGKTFGFKML

SEQ ID NO: 795195 - protein, 245 aa, Homo sapiens; identical to SEQ ID NO: 795189

SEQ ID NO: 795196 - protein, 1166 aa, Homo sapiens
ILDCQNHTCMKECHKVTKTDGCTGKNKAGPECLHCEEGCSKSRPLGCLHPCILRCHPGECPPCVQMLRIKCHCKITSLYVECRKITTADVNEKNLLSCCKNQCPKELPCGHRCKEMCHPGECPFNCNQKVKLRCPCKRIKKELQCNKVRENQVSIECDTTCKEMKRKASEIKEAEAKAALEEEKRRQQAELEAFENRLKGRRKKNRKRDEVAVLRADDNNMGNGCSQKLATANLLRFLLLVLIPCICALVLLLVILLSYVGACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGERIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 795197 - protein, 962 aa, Homo sapiens
ILDCQNHTCMKECHKVTKTDGCTGKNKAGPECLHCEEGCSKSRPLGCLHPCILRCHPGECPPCVQMLRIKCHCKITSLYVECRKITTADVNEKNLLSCCKNQCPKELPCGHRCKEMCHPGECPFNCNQKVKLRCPCKRIKKELQCNKVRENQVSIECDTTCKEMKRKASEIKEAEAKAALEEEKRRQQAELEAFENRLKGRRKKNRKRDEVAVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGERIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCGELLVSAICCTLSCLSATEAEWILNYFLDFTDQVHLFCFTVIKADSADLCVLFPTHRKFPHEATSLFEISILYGKTFGFKML

SEQ ID NO: 795198 - protein, 133 aa, Homo sapiens
SLYPPYSLEVESNHRSAGFFLCTWQPLEGKACTFPAVTPAHVSHIISLSCSKNFSPERRWQRWAGGAKVGALTARFQGALLSQPTTMVRQGDSAGLRIRALKMAFVLLVFSLFICCLFSDDVLVKSSFENPKL

SEQ ID NO: 795199 - protein, 1363 aa, Homo sapiens
LTIGARAAARGRSFNSPQWSPLFPLASSNSYSQGRWLWVAITMSDSVILRSIKKFGEENDGFESDKSYNNDKKSRLQDEKKGDGVRVGFFQLFRFSSSTDIWLMFVGSLCAFLHGIAQPGVLLIFGTMTDVFIDYDVELQELQIPGKACVNNTIVWTNSSLNQNMTNGTRCGLLNIESEMIKFASYYAGIAVAVLITGYIQICFWVIAAARQIQKMRKFYFRRIMRMEIGWFDCNSVGELNTRFSDDINKINDAIADQMALFIQRMTSTICGFLLGFFRGWKLTLVIISVSPLIGIGAATIGLSVSKFTDYELKAYAKAGVVADEVISSMRTVAAFGGEKREVERYEKNLVFAQRWGIRKGIVMGFFTGFVWCLIFLCYALAFWYGSTLVLDEGEYTPGTLVQIFLSVIVGALNLGNASPCLEAFATGRAAATSIFETIDRKPIIDCMSEDGYKLDRIKGEIEFHNVTFHYPSRPEVKILNDLNMVIKPGEMTALVGPSGAGKSTALQLIQRFYDPCEGMVTVDGHDIRSLNIQWLRDQIGIVEQEPVLFSTTIAENIRYGREDATMEDIVQAAKEANAYNFIMDLPQQFDTLVGEGGGQMSGGQKQRVAIARALIRNPKILLLDMATSALDNESEAMVQEVLSKIQHGHTIISVAHRLSTVRAADTIIGFEHGTAVERGTHEELLERKGVYFTLVTLQSQGNQALNEEDIKDATEDDMLARTFSRGSYQDSLRASIRQRSKSQLSYLVHEPPLAVVDHKSTYEEDRKDKDIPVQEEVEPAPVRRILKFSAPEWPYMLVGSVGAAVNGTVTPLYAFLFSQILGTFSIPDKEEQRSQINGVCLLFVAMGCVSLFTQFLQGYAFAKSGELLTKRLRKFGFRAMLGQDIAWFDDLRNSPGALTTRLATDASQVQGAAGSQIGMIVNSFTNVTVAMIIAFSFSWKLSLVILCFFPFLALSGATQTRMLTGFASRDKQALEMVGQITNEALSNIRTVAGIGKERRFIEALETELEKPFKTAIQKANIYGFCFAFAQCIMFIANSASYRYGGYLISNEGLHFSYVFRVISAVVLSATALGRAFSYTPSYAKAKISAARFFQLLDRQPPISVYNTAGEKWDNFQGKIDFVDCKFTYPSRPDSQVLNGLSVSISPGQTLAFVGSSGCGKSTSIQLLERFYDPDQGKVMIDGHDSKKVNVQFLRSNIGIVSQEPVLFACSIMDNIKYGDNTKEIPMERVIAAAKQAQLHDFVMSLPEKYETNVGSQGSQLSRGEKQRIAIARAIVRDPKILLLDEATSALDTESEKTVQVALDKAREGRTCIVIAHRLSTIQNADIIAVMAQGVVIEKGTHEELMAQKGAYYKLVTTGSPIS

SEQ ID NO: 795200 - protein, 447 aa, Homo sapiens
LTIGARAAARGRSFNSPQWSPLFPLASSNSYSQGRWLWVAITMSDSVILRSIKKFGEENDGFESDKSYNNDKKSRLQDEKKGDGVRVGFFQLFRFSSSTDIWLMFVGSLCAFLHGIAQPGVLLIFGTMTDVFIDYDVELQELQIPGKACVNNTIVWTNSSLNQNMTNGTRCGLLNIESEMIKFASYYAGIAVAVLITGYIQICFWVIAAARQIQKMRKFYFRRIMRMEIGWFDCNSVGELNTRFSDDINKINDAIADQMALFIQRMTSTICGFLLGFFRGWKLTLVIISVSPLIGIGAATIGLSVSKFTDYELKAYAKAGVVADEVISSMRTVAAFGGEKREVERYEKNLVFAQRWGIRKGIVMGFFTGFVWCLIFLCYALAFWYGSTLVLDEGEYTPGTLVQIFLSVIVGALNLGNASPCLEAFATGRAAATSIFETIDRVCISQK

SEQ ID NO: 795201 - protein, 123 aa, Homo sapiens
LVPGSDPSRERLGMKGWGDDMSIRLQLLLQGPFMEAYFLGPLPRTPSPCSQPHPPLSLTVRLQSMAYIFPLPESQPQLSQFLAAMVLGPPLNFQTFCLVPPSLPRTLAYLSVLPCVSPQPGSP

SEQ ID NO: 795202 - protein, 125 aa, Homo sapiens
MSSTLGKLSNQVEETLPLLKKVPANYFHICSAILMGFSLSKSATQVSAIHMDSKVDDHLIRGTEKSRLEPATQLFQNTKKIRLEDTNQENFTRIEGTGTGSLSGKALGSVVYVKESDGLEMTDVE

SEQ ID NO: 795203 - protein, 102 aa, Homo sapiens
SQNRFWNSFSRPRAREGSPAPGKPGHPLGCPSTPQPQVLSQHLSALPVNPDCDSRLRAKPRPLPPPSVGHNCQGDLPDRPSPPTVSSRQQPTEQPPTKLPCP

SEQ ID NO: 795204 - protein, 87 aa, Homo sapiens
TLSVFALKEEHGGTTQCLHCATRTKDTSVTGRHSSLGKSDTTMLLLPSQAHGKEKCLPGVSATQPPVLYHYCPLHRRPAPSSSSSGH

SEQ ID NO: 795205 - protein, 117 aa, Homo sapiens
TDTRPGAMLSLCSYKGNRMPKTGLVNPNSKPPRSAGTQGALLLEGVVDASLFTSFVLTRQWGCPGDISHPVLGHFRGSGELPCSLSIPKDGSGEATGAGEPAPVRSEPHPPPLCWCE

SEQ ID NO: 795206 - protein, 89 aa, Homo sapiens
TWCNFQFYTSLMNSVNRQHKYNSVIPMRPLNNPLPRERTPFALQTINALEEESRGFPTQVERIFQESVYKTQQTIWKETRNMVQRQFIA

SEQ ID NO: 795207 - protein, 67 aa, Homo sapiens
GDFSPPPSKLPRHGHRHELGVLQLSSDTLYLETASDPRGWGLSPPRPPLTFRHHSLVQASGTSDNQL

SEQ ID NO: 795208 - protein, 158 aa, Homo sapiens
RRGRGKQHGIPASGLPGRCWLGIKMSTLQPRTRAPEELFVPQESSGSTQENMLVSFHGSSLRNEATPRYSQQEEAGNGRWQQSLSLERWPLWTSHPLGTPPLMPVAVARCCILPGLWPLLSPPSGSASPVSQGPGCLSLWPNAFKKDDFPVRQGDTFW

SEQ ID NO: 795209 - protein, 78 aa, Homo sapiens
FLGEQNWSQIWRFFCWEARAGAGAPEASRFWLRGRGLSRAIRPHTVQQMGRGPRHHPGDRRGDLHRKSGAGLLAPGPS

SEQ ID NO: 795210 - protein, 463 aa, Homo sapiens
MRAGPEPQALVGQKRGALRLLVPRLVLTVSAPAEVRRRVLRPVLSWMDRETRALADSHFRGLGVDVPGVGQAPGRVAFVSEPGAFSYADFVRGFLLPNLPCVFSSAFTQGWGSRRRWVTPAGRPDFDHLLRTYGDVVVPVANCGVQEYNSNPKEHMTLRDYITYWKEYIQAGYSSPRGCLYLKDWHLCRDFPVEDVFTLPVYFSSDWLNEFWDALDVDDYRFVYAGPAGSWSPFHADIFRSFSWSVNVCGRKKWLLFPPGQEEALRDRHGNLPYDVTSPALCDTHLHPRNQLAGPPLEITQEAGEMVFVPSGWHHQVHNLDDTISINHNWVNGFNLANMWRFLQQELCAVQEEVSEWRDSMPDWHHHCQVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 795211 - protein, 447 aa, Homo sapiens
MRAGPEPQALVGQKRGALRLLVPRLVLTVSAPAEVRRRVLRPVLSWMDRETRALADSHFRGLGVDVPGVGQAPGRVAFVSEPGAFSYADFVRGFLLPNLPCVFSSAFTQGWGSRRRWVTPAGRPDFDHLLRTYGDVVVPVANCGVQEYNSNPKEHMTLRDYITYWKEYIQAGYSSPRGCLYLKDWHLCRDFPVEDVFTLPVYFSSDWLNEFWDALDVDDYRFVYAGPAGSWSPFHADIFRSFSWSVNVCGRKKWLLFPPGQEEALRDRHGNLPYDVTSPALCDTHLHPRNQLAGPPLEITQEAGEMVFVPSGWHHQVHNLDDTISINHNWVNGFNLANMWRFLQQELCAVQEEVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 795212 - protein, 164 aa, Homo sapiens
MWVGQGAPAMGSGLPALCPFQDDTISINHNWVNGFNLANMWRFLQQELCAVQEEVSEWRDSMPDWHHHCQVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 795213 - protein, 126 aa, Homo sapiens
KGQGGLGVLGPFPFNLQGGMGACWEPKPGGGLRLPLGTQSGGLGWAGLCHLPAFAGPVDSWRGHRWGGIPSAAESSPGPEGLCLLCTHSWVFPRMLFSGVVGPQPLFTLGMMEVWAGSSRPIKAQQ

SEQ ID NO: 795214 - protein, 133 aa, Homo sapiens
GRRPRAGRKGRRDPGPGGPRLERGTREGEGGQARGPWRVPLQTVWSEDGAQGDGMDRAFHFRRRGCTSCKLWGPGIQLEPQRAHDSQRLHHLLERVHTGGLLLSQGLSLPQRLALVQVMGLGTHRGAAFPSAA

SEQ ID NO: 795215 - protein, 167 aa, Homo sapiens
GRRPRAGRKGRRDPGPGGPRLERGTREGEGGQARGPWRVPLQTVWSEDGAQGDGMDRAFHFRRRGCTSCKLWDPLAEDAPGLNPLVDPQFVETGTLPALSLTESPAFFQLAPGWLPHPSRGGGIRIHRDGTCHGYAHCLPVASTGAAGTCLGWKPPRRAGVSVCSVQ

SEQ ID NO: 795216 - protein, 176 aa, Homo sapiens
GRRPRAGRKGRRDPGPGGPRLERGTREGEGGQARGPWRVPLQTVWSEDGAQGDGMDRAFHFRRRGCTSCKLWGPGIQLEPQRAHDSQRLHHLLERVHTGGLLLSQGLSLPQRLALVQVMGLGTHRCVNPEAFLMKVAPGCTTELFFPVRHFNQFKRNWIVFRMAASVVLWEVNMVF

SEQ ID NO: 795217 - protein, 422 aa, Homo sapiens
WYWSRIRLMTRALADSHFRGLGVDVPGVGQAPGRVAFVSEPGAFSYADFVRGFLLPNLPCVFSSAFTQGWGSRRRWVTPAGRPDFDHLLRTYGDVVVPVANCGVQEYNSNPKEHMTLRDYITYWKEYIQAGYSSPRGCLYLKDWHLCRDFPVEDVFTLPVYFSSDWLNEFWDALDVDDYRFVYAGPAGSWSPFHADIFRSFSWSVNVCGRKKWLLFPPGQEEALRDRHGNLPYDVTSPALCDTHLHPRNQLAGPPLEITQEAGEMVFVPSGWHHQVHNLDDTISINHNWVNGFNLANMWRFLQQELCAVQEEVSEWRDSMPDWHHHCQVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 795218 - protein, 439 aa, Homo sapiens
MRAGPEPQALVGQKRGALRLLVPRLVLTVSAPAEVRRRVLRPVLSWMDRETRALADSHFRGLGVDVPGVGQAPGRVAFVSEPGAFSYADFVRGFLLPNLPCVFSSAFTQGWGSRRRWVTPAGRPDFDHLLRTYGDVVVPVANCGVQEYNSNPKEHMTLRDYITYWKEYIQAGYSSPRGCLYLKDWHLCRDFPVEDVFTLPVYFSSDWLNEFWDALDVDDYRFVYAGPAGSWSPFHADIFRSFSWSVNVCGRKKWLLFPPGQEEALRDRHGNLPYDVTSPALCDTHLHPRNQLAGPPLEITQEAGEMVFVPSGWHHQVHNLQELCAVQEEVSEWRDSMPDWHHHCQVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 795219 - protein, 463 aa, Homo sapiens; identical to SEQ ID NO: 795210

SEQ ID NO: 795220 - protein, 412 aa, Homo sapiens
AGWIGRRFRGLGVDVPGVGQAPGRVAFVSEPGAFSYADFVRGFLLPNLPCVFSSAFTQGWGSRRRWVTPAGRPDFDHLLRTYGDVVVPVANCGVQEYNSNPKEHMTLRDYITYWKEYIQAGYSSPRGCLYLKDWHLCRDFPVEDVFTLPVYFSSDWLNEFWDALDVDDYRFVYAGPAGSWSPFHADIFRSFSWSVNVCGRKKWLLFPPGQEEALRDRHGNLPYDVTSPALCDTHLHPRNQLAGPPLEITQEAGEMVFVPSGWHHQVHNLDDTISINHNWVNGFNLANMWRFLQQELCAVQEEVSEWRDSMPDWHHHCQVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 795221 - protein, 339 aa, Homo sapiens [sequence omitted]

SEQ ID NO: 795222 - protein, 356 aa, Homo sapiens
RLGRGPCYSAEAPRGVPDFDHLLRTYGDVVVPVANCGVQEYNSNPKEHMTLRDYITYWKEYIQAGYSSPRGCLYLKDWHLCRDFPVEDVFTLPVYFSSDWLNEFWDALDVDDYRFVYAGPAGSWSPFHADIFRSFSWSVNVCGRKKWLLFPPGQEEALRDRHGNLPYDVTSPALCDTHLHPRNQLAGPPLEITQEAGEMVFVPSGWHHQVHNLDDTISINHNWVNGFNLANMWRFLQQELCAVQEEVSEWRDSMPDWHHHCQVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 795223 - protein, 447 aa, Homo sapiens; identical to SEQ ID NO: 795211

SEQ ID NO: 795224 - protein, 592 aa, Homo sapiens
MRAGPEPQALVGQKRGALRLLVPRLVLTVSAPAEVRRRVLRPVLSWMDRETRALADSHFRGLGVDVPGVGQAPGRVAFVSEPGAFSYADFVRGFLLPNLPCVFSSAFTQGWGSRRRWVTPAGRPDFDHLLRTYGDVVVPVANCGVQEYNSNPKEHMTLRDYITYWKEYIQAGYSSPRGCLYLKDWHLCRDFPVEDVFTLPVYFSSDWLNEFWDALDVDDYRFVYAGPAGSWSPFHADIFRSFSWSVNVCGRKKWLLFPPGQEEALRDRHGNLPYDVTSPALCDTHLHPRNQLAGPPLEITQEAGEMVFVPSGWHHQVHNLVMCCFSCPLSGAFLQEDGSTTSPLSQPELGWNGVAHGLRLTPSQGGVAEAYASVSPTAGPWVYLLWVHCGLRWSEPATHFPAEQALLGDRRALLAAEGWTPQWVLAQEMWVGQGAPAMGSGLPALCPFQDDTISINHNWVNGFNLANMWRFLQQELCAVQEEVSEWRDSMPDWHHHCQVIMRSCSGINFEEFYHFLKVIAEKRLLVLREAAAEDGAGLGFEQAAFDVGRITEVLASLVAHPDFQRVDTSAFSPQPKELLQQLREAVDAAAAP

SEQ ID NO: 795225 - protein, 110 aa, Homo sapiens
MARGNQRELARQKNMKKTQEISKGKRKEDSLTASQRKQSSGGQKSESKMSAGPHLPLKAPRENPCFPLPAAGGSRYYLAYGSITPISAFVFVVFFSVFFPSFYEDFCCWI

SEQ ID NO: 795226 - protein, 79 aa, Homo sapiens
GGVRLENPPGSRSAGIPASVGRERARGWFRSGFSGRTGACPSGASLCGKEHTPEMWTRPPQEGPCLEVEINENLPARKT

SEQ ID NO: 795227 - protein, 274 aa, Homo sapiens
MKGRRLLFQGHARPTTPGPRRTRTTRSRRWRQLPTLTRPLLPRLPAPPAAPPLSHGMLGARGGVGPAGPGERGGSCRRGGAERGGADSRPPRPPRPQALGRRRGLGVVVTNPKTRDLHYCGHTLFSQTLPGKHRRAGQSGVNRRPIKDLQCGWWGLVPWGASAHRRALGFTCASFPTFYGGEWKVKIVRSRGGYPPSQPPPEMCPSSPSTFYHFFPMKKTKRCKGREYPRPPNPVLCNVKCALKSSHPEACPPSAGERSWGLGAVGHACNPSTL

SEQ ID NO: 795228 - protein, 107 aa, Homo sapiens
IFLTVNYQITFGCIVSLSVHGFVSLWQRQLADKLIKIPELQIKLGPGVAVKFQTQRPIQSVHYIPILMRAEQTLMRDMTSASPITKKRDYHTDDLPGGFIARFDLMN

SEQ ID NO: 795229 - protein, 1327 aa, Homo sapiens
MAASRRSQHHHHHHQQQLQPAPGASAPPPPPPPPLSPGLAPGTTPASPTASGLAPFASPRHGLALPEGDGSRDPPDRPRSPDPVDGTSCCSTTSTICTVAAAPVVPAVSTSSAAGVAPNPAGSGSNNSPSSSSSPTSSSSSSPSSPGSSLAESPEAAGVSSTAPLGPGAAGPGTGVPAVSGALRELLEACRNGDVSRVKRLVDAANVNAKDMAGRKSSPLHFAAGFGRKDVVEHLLQMGANVHARDDGGLIPLHNACSFGHAEVVSLLLCQGADPNARDNWNYTPLHEAAIKGKIDVCIVLLQHGADPNIRNTDGKSALDLADPSAKAVLTGEYKKDELLEAARSGNEEKLMALLTPLNVNCHASDGRKSTPLHLAAGYNRVRIVQLLLQHGADVHAKDKGGLVPLHNACSYGHYEVTELLLKHGACVNAMDLWQFTPLHEAASKNRVEVCSLLLSHGADPTLVNCHGKSAVDMAPTPELRERLTYEFKGHSLLQAAREADLAKVKKTLALEIINFKQPQSHETALHCAVASLHPKRKQVTELLLRKGANVNEKNKDFMTPLHVAAERAHNDVMEVLHKHGAKMNALDTLGQTALHRAALAGHLQTCRLLLSYGSDPSIISLQGFTAAQMGNEAVQQILSESTPIRTSDVDYRLLEASKAGDLETVKQLCSSQNVNCRDLEGRHSTPLHFAAGYNRVSVVEYLLHHGADVHAKDKGGLVPLHNACSYGHYEVAELLVRHGASVNVADLWKFTPLHEAAAKGKYEICKLLLKHGADPTKKNRDGNTPLDLVKEGDTDIQDLLKGDAALLDAAKKGCLARVQKLCTPENINCRDTQGRNSTPLHLAAGYNNLEVAEYLLEHGADVNAQDKGGLIPLHNAASYGHVDIAALLIKYNTCVNATDKWAFTPLHEAAQKGRTQLCALLLAHGADPTMKNQEGQTPLDLATADDIRALLIDAMPPEALPTCFKPQATVVSASLISPASTPSCLSAASSIDNLTGPLAELAVGGASNAGDGAAGTERKEGEVAGLDMNISQFLKSLGLEHLRDIFETEQITLDVLADMGHEELKEIGINAYGHRHKLIKGVERLLGGQQGTNPYLTFHCVNQGTILLDLAPEDKEYQSVEEEMQSTIREHRDGGNAGGIFNRYNVIRIQKVVNKKLRERFCHRQKEVSEENHNHHNERMLFHGSPFINAIIHKGFDERHAYIGGMFGAGIYFAENSSKSNQYVYGIGGGTGCPTHKDRSCYICHRQMLFCRVTLGKSFLQFSTMKMAHAPPGHHSVIGRPSVNGLAYAEYVIYRGEQAYPEYLITYQIMKPEAPSQTATAAEQKT

SEQ ID NO: 795230 - protein, 77 aa, Homo sapiens
ATIYLEDLDKTIEGGYSTQQIFNIDKTAFYWKKMSSRTFLAREEKSIPGFNASKEGLRSVAYTCNSSTSGDQGKTMA

SEQ ID NO: 795231 - protein, 117 aa, Homo sapiens
LWGLCLLANQHPIPGNIFGAFCYLLFRDGCRALCPMSRGGECPVSSPPNHFLHHPGLHSPCYFLHFSLPNPSHKEAPKTGSQIWSPASAPHTRAFQEDEFYGSILSDSRFTTLKGSL

SEQ ID NO: 795232 - protein, 534 aa, Homo sapiens
MFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANDIARLMVMVRQEESLMPSQVVKGGAFDGTMNGPFGHGYGEGAGEGIDDVEWVVGKDKPSYDEIFYTLSPVNGKITGANVKKEMVKSKLPNTELGKIWKLADVDKDGLLDDEEFALANHLIKVKLEGHELPADLPPHLVPPSKRRHE

SEQ ID NO: 795233 - protein, 571 aa, Homo sapiens
ILTSLDSQRGLCVAGEDGGGVSPMEQPGTAASPVSGSMFSWVSKDARRKKEPELFQTVAEGLRQLYAQKLLPLEEHYRFHEFHSPALEDADFDNKPMVLLVGQYSTGKTTFIRHLIEQDFPGMRIGPEPTTDSFIAVMHGPTEGVVPGNALVVDPRRPFRKLNAFGNAFLNRFMCAQLPNPVLDSISIIDTPGILSGEKQRISRGYDFAAVLEWFAERVDRIILLFDAHKLDISDEFSEVIKALKNHEDKIRVVLNKADQIETQQLMRVYGALMWSLGKIINTPEVVRVYIGSFWSHPLLIPDNRKLFEAEEQDLFKDIQSLPRNAALRKLNDLIKRARLAKVHAYIISSLKKEMPNVFGKESKKKELVNNLGEIYQKIEREHQISPGDFPSLRKMQELLQTQDFSKFQALKPKLLDTVDDMLANDIARLMVMVRQEESLMPSQVVKGGAFDGTMNGPFGHGYGEGAGEGIDDVEWVVGKDKPSYDEIFYTLSPVNGKITGANVKKEMVKSKLPNTELGKIWKLADVDKDGLLDDEEFALANHLIKVKLEGHELPADLPPHLVPPSKRRHE

SEQ ID NO: 795234 - protein, 141 aa, Homo sapiens
VEPADMSDAVTKASKCRWGTNSLTSEEDDSGLCSPPAEREEKQGILTGDQSRIKSLSSTEDILVTDQYRPFFSVNSISEQKIPLLSCQSAHPDENFKMILHDVSPLEEAKHVNGQREIHDENCCLQNNLKESPVKCDPLIM

SEQ ID NO: 795235 - protein, 107 aa, Homo sapiens
ERASFRVGEVVGRSLGELLTAQHQHCHGSRLLPTPPSWGTGCASRNSTQAAETPSPPLTSPDCPSGCSVALRAATVLKLLSPASLGFIVITPLSAVLLLLAINSGLP

SEQ ID NO: 795236 - protein, 123 aa, Homo sapiens
GFQMRPPPALRATRFPLPRGASTRQGTHALPPFSLPPTSPVRVISGALSFWHEMLQGPVVFSLPQPEPSYFCCSLVHCGRMSCRARDLAPDVLIATGVSLQLAEQGNTSMYMPTRICIHTVSW

SEQ ID NO: 795237 - protein, 183 aa, Homo sapiens
MCACMLHVAVAYVCECICVCVCARAPTSPGSFHPLSLLPPPTLPYSDSLLTSLLSLILPTAIPLPLPPYYAFPPSPSPLRASFPSSPPLLPLFSSAPYALHSAKLLTYSRHYYSSSSSLTLTHPPPAPPRPSSSALLTHSPYPSLHYASRAPTSPHSPLSLALSLLFPLTPLLFVSYITSPLL

SEQ ID NO: 795238 - protein, 101 aa, Homo sapiens
GCETPRLPEIALRALPRPGVSSLGTILCVPSVPVGPIVLTSATPESSRFTRPAPSTVPEAHRHSRILRLAPVPCRCYRPPAPAHTSRSTSLFYESPSTFNV

SEQ ID NO: 795239 - protein, 106 aa, Homo sapiens
MPRMLRDRAWHSTGRWARFGPCAAWRCCARSAWVSAPPGVPGAALGASCLGRERTRAAAGFTRRAAAAITRVSKPRLLNADRPRRPAEAGMGGRPPSRAQTGVAEV

SEQ ID NO: 795240 - protein, 251 aa, Homo sapiens
LYAPDVTGPSMAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 795241 - protein, 273 aa, Homo sapiens
MGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTEDPAAAGGAAVDRRRQKLPVPRGRAGRAIGRGEGAAGRPVGVSLAVLRGHRPQPAPPQELPRPQGLCVLLWAGPCSPGSRSGCRKVAVTSALDHAVRRPRLGPAGGRERHSHGPLPPLLALMGWGLRTGGCVRGCAVPSTGPGCRGP

SEQ ID NO: 795242 - protein, 244 aa, Homo sapiens
LYAPDVTGPSMAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRKTQLLLEVPPSTEDARSCQFPEEERGERSAEEKGRLGDLWV

SEQ ID NO: 795243 - protein, 109 aa, Homo sapiens
CLHPLLTRTSPGSGFSGHERSQPPPGRAGEDGDGACPTGCGLLKPEHGTARGDGRVSGPVRPGAAVRAQPGSAPHRGSRVRPWAPPAWDGNGRALLPGSHDALLPRLPG

SEQ ID NO: 795244 - protein, 149 aa, Homo sapiens
MFCSEKKLREVERIVKANDREYNEKFQYADNRIHTSKYNILTFLPINLFEQFQRVANAYFLCLLILQLIPEISSLTWFTTIVPLVLVITMTAVKDATDDYFRHKSDNQVNNRQSEVLINSKLQNEKWMNVKVGDIIKLENNQFVALIKD

SEQ ID NO: 795245 - protein, 310 aa, Homo sapiens
MFCSEKKLREVERIVKANDREYNEKFQYADNRIHTSKYNILTFLPINLFEQFQRVANAYFLCLLILQLIPEISSLTWFTTIVPLVLVITMTAVKDATDDYFRHKSDNQVNNRQSEVLINSKLQNEKWMNVKVGDIIKLENNQFVAADLLLLSSSEPHGLCYVETAELDGETNLKVRHALSVTSELGADISRLAGFDGIVVCEVPNNKLDKFMGILSWKDSKHSLNNEKIILRGCILRNTSWCFGMVIFAGPDTKLMQNSGKTKFKRTSIDRLMNTLVLWEIQSGRVKLGTNSELSSFGMKERRALCSPDS

SEQ ID NO: 795246 - protein, 403 aa, Homo sapiens [sequence omitted]

SEQ ID NO: 795247 - protein, 67 aa, Homo sapiens
GATGCEKTTEGTQCRQNQALSKCSLVIFRHQSKLEFWIGVKKSRHITQITECFKSPPCHTRPGYNCI

SEQ ID NO: 795248 - protein, 72 aa, Homo sapiens
MRTKSEREIHLCVLGFFFFFETGSRSVAQAGVQRHSHGSLQPRPPGLIQFSHLSLPSSWDYRHAPPHLVNFL

SEQ ID NO: 795249 - protein, 68 aa, Homo sapiens
SAQPEDCEDGEDAPRPGREVTGTQTGGDGRGAQWFTPVIPALWQVEACGSPKVRSSRPAWPTWRNCLY

SEQ ID NO: 795250 - protein, 101 aa, Homo sapiens
TLHTLPEGSHPSPWRQPPPEDPLGLNCLLSATPSSPASSVFLPGWNAPQHCQLNLLTKTQLVISPLGQPWLPGSWTWSPRSKIQGSLIWTELDGKVLMFQC

SEQ ID NO: 795251 - protein, 178 aa, Homo sapiens
PAAELTGSVCTTGRAALAKNSALPSSTCEPPLDSEPGRLKEPGALHTPHPGPGPGPTTEAEAAGTALAPQVPRRVAGPLAEALPRPSEMGAGGASFRALAWASLPLLGPPACALCEDTLCCGESPQERPGSRRSLPGSLSEKSPSMEPSAATPFRVTVTISASPTPPLPPPSPPRPGC

SEQ ID NO: 795252 - protein, 127 aa, Homo sapiens
NAWAPAGLSGAADGARVSAPRPGPVPGGRQHVRGRQRQEEHREVLLLLPAAEAAPAAATEEPLPQPDPACQGVASRKAGLSAQPAWQPFREEPQHGALGRHAVPGHGNYLCVTNTATATTITTSPGV

SEQ ID NO: 795253 - protein, 172 aa, Homo sapiens
PAAELTGSVCTTGRAALAKNSALPSSTCEPPLDSEPGALHTPHPGPGPGPTTEAEAAGTALAPQVPRRVAGPLAEALPRPSEMGAGGASFRALAWASLPLLGPPACALCEDTLCCGESPQERPGSRRSLPGSLSEKSPSMEPSAATPFRVTVTISASPTPPLPPPSPPRPGC

SEQ ID NO: 795254 - protein, 123 aa, Homo sapiens
GVGGSFFLEQMPPPQRLPETALLSSEVLKYPGLHPWTVRVGAPSPPPSVISLPCVLFWGRGHKNWHTVCFQEILTEWIETSHQAHTSSSLCPWRSLSGDSGVWLRLLKCFYCDRGPGYSPTPL

SEQ ID NO: 795255 - protein, 74 aa, Homo sapiens
DYSTAPEYQSVPLRRQREQYKRIQEPQPESETRQIAECIYHLDATDVDSYSFKILIFNMTMHVTCQGIEKLKVQ

SEQ ID NO: 795256 - protein, 69 aa, Homo sapiens
RRAFPLARAAARPDLGPRRPSLRVGTWGCRGSGPGEGPESCPGLELELVGCVVNVETFAAHWTSFLDIQ

SEQ ID NO: 795257 - protein, 69 aa, Homo sapiens; identical to SEQ ID NO: 795256

SEQ ID NO: 795258 - protein, 93 aa, Homo sapiens
KGKTVVARILPFLSTEQAADIFMTTARDLPFLIKKDAQDEVLPCLLSPFSLLLYHLPTVTITSLLQQLMNLPQSAATPAPSNPHFTAVLQNKF

SEQ ID NO: 795259 - protein, 74 aa, Homo sapiens
WGTRTRREGELGIYGQILILLAVVNYTHVNRAAALLYFRRLLALLVGPFPGPSQQGLPPVDACVLPWHRPLCFA

SEQ ID NO: 795260 - protein, 64 aa, Homo sapiens
MVGMTRVAGGLCIGCWMRAEAPMEVQACFAAPPDPSIPSHQCDKVSASRGQEGRDPAQPLLLSS

SEQ ID NO: 795261 - protein, 167 aa, Homo sapiens
MSAEWHCPLVSTLCLFYPECATQGSASSSGARRGRVSLGQRVMRAGLRPLGWQLGLRLPSRAGLVPVSPQASSRRLLRGRCFLERSRGLRATSLRLRLPRSESEHPRLRGRGVNEQCGCSQHAPASLSAPGVPAREHAVESAPDLCPPSRCVDSRSPPGRGGSQRSR

SEQ ID NO: 795262 - protein, 290 aa, Homo sapiens
PKTFPSLHITRGIYIPKIPVSGLQGGCYFLMVGHKNEPARGFPQQAHNHLRKPYGPAWIAYGHSFAVESEHEQAMAAYFTAAQLMKGWKQPENCFSDALERIKPFGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 795263 - protein, 347 aa, Homo sapiens
PKTFPSLHITRGIYIPKIPVSGLQGGCYFLMVGHKNEPARGFPQQAHNHLRKPYGPAWIAYGHSFAVESEHEQAMAAYFTAAQLMNRVSFAYAAILDYEYGLTNNSNKLDLKGSSAKLCALHRKTLLCYACRSAVDCQNFTNGEWKTAEKWFLDALEKIKAIGNEVTVDKWEPLLNNLGHVCRKLKKYAEALDYHRQALVLIPQNASTYSAIGYIHSLMGNFENAVDYFHTALGLRRDDTFSVTMLGHCIEMYIGDSEAYIGADIKDKLKCYDFDVHTMKTLKNIISPPWDFREFEVEKQTAEETGLTPLETSRKTPDSRPSLEETFEIEMNESDMMLETSMSDHST

SEQ ID NO: 795264 - protein, 34 aa, Homo sapiens
EGREGYVVGEGGGRVAAALAVSGCPAVSRGSARP

SEQ ID NO: 795265 - protein, 105 aa, Homo sapiens
MALRMEPGKQQAPIPQPQGSRLAPCTEARMQSLSLRASLSTRPHRADHQQHRCGAGRVGEKPIRGCSKKVQSQHLGATGDSEGTHRSNTDRTWPRGNQQPNLNNL

SEQ ID NO: 795266 - protein, 537 aa, Homo sapiens [sequence omitted]

SEQ ID NO: 795267 - protein, 388 aa, Homo sapiens
SLISNSRPRRREAPGSVGAPAAQAATHLGDLRGGGGGGWVESGPGAHAGTPGPPGTERRGAARRDPGEGAAMRAAAAAGGVRTAALALLLGALHWAPARCEEYDYYGWQAEPLHGRSYSKPPQCLDIPADLPLCHTVGYKRMRLPNLLEHESLAEVKQQASSWLPLLAKRCHSDTQVFLCSLFAPVCLDRPIYPCRSLCEAVRAGCAPLMEAYGFPWPEMLHCHKFPLDNDLCIAVQFGHLPATAPPVTKICAQCEMEHSADGLMEQMCSSDFVVKMRIKEIKIENGDRKLIGAQKKKKLLKPGPLKRKDTKRLVLHMKNGAGCPCPQLDSLAGSFLVMGRKVDGQLLLMAVYRWDKKNKEMKFAVKFMFSYPCSLYYPFFYGAAEPH

SEQ ID NO: 795268 - protein, 984 aa, Homo sapiens
MDDRYPALQRAQLRLDFIHANSTTHSFLFGALAELLDNARDAGAERLDVFSVDNEKLQGGFMLCFLDDGCGMSPEEASDIIYFGRSKKRLSTLKFIGQYGNGLKSGSMRIGKDFILFTKKEETMTCVFFSQTFCEEESLSEVVVPMPSWLIRTRESVTDDPQKFAMELSIIYKYSPFKTEAELMQQFDVIYGKCGTLLVIYNLKLLLNGEPELDVKTDKEDILMAGALEDFPARWSFRAYTSVLYFNPWMRIFIQAKRVKTKHLCYCLYRPRKYLYVTSSFKGAFKDEVKKAEEAVKIAESILKEAQIKVNQCDRTSLSSAKDVLQRALEDVEAKQKNLKEKQRELKTARTLSLFYGVNVENRSQAGMFIYSNNRLIKMHEKVGSQLKLKSLLGAGVVGIVNIPLEVMEPSHNKQEFLNVQEYNHLLKVMGQYLVQYCKDTGINNRNLTLFCNEFGYQNDIDVEKPLNSIQYQRRQAMGIPFIIQCDLCLKWRVLPSSTNYQEKEFFDIWICANNPNRLENSCHQVECLPSIPLGTMSTISPSKNEKEKQLRESVIKYQNRLAEQQPQPQFIPVDEITVTSTCLTSAHKENTKTQKIRLLGDDLKHESLSSFELSASRRGQKRNIEETDSDVEYISETKIMKKSMEEKMNSQQQRIPVALPENVKLAERSQRSQIANITTVWRAQPTEGCLKNAQAASWEMKRKQSLNFVEECKVLTEDENTSDSDIILVSDKSNTDVSLKQEKKEIPLLNQEKQELCNDVLAMKRSSSLPSWKSLLNVPMEDVNLSSGHIARVSVSGSCKVASSPASSQSTPVKETVRKLKSKLREILLYFFPEHQLPSELEEPALSCELEQCPEQMNKKLKMCFNQIQNTYMVQYEKKIKRKLQSIIYDSNTRGIHNEISLGQCENKRKISEDKLKNLRIKLALLLQKLQLGGPEGDLEQTDTYLEALLKEDNLLFQNNLNKVTIDARHRLPLEKNEKTSEN

SEQ ID NO: 795269 - protein, 984 aa, Homo sapiens; identical to SEQ ID NO: 795268

SEQ ID NO: 795270 - protein, 120 aa, Homo sapiens
HARPNPQATYQSTSQTLSSLPPHVHGLHMPFIILHQRRASEGIFESCLPGPRPARSHSFPDAIQPCRAACPRAKLVARPTPGTELTFSRVCSLPGISARPPVLRLLMFVCQGQVECSPLG

SEQ ID NO: 795271 - protein, 529 aa, Homo sapiens
RSTWRGRVATAAAPARPGSDMEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALCPLVQTPPAPTSEMVPVISSMYPIALTRAEMSNGAPQELERKSILLPEKSVPSERGLSPNNSGHDSTDTDSNHEERQNHIYQQNHMVLSRARNGMPLLKEVPRSYELLKPPPICPRDSVKVIDKEGEVMDVYRCDHCRVLFLDYVMFTIHMGCHGFRDPFECNMCGDRSHDRYEFSSHIARGEHRSLLK

SEQ ID NO: 795272 - protein, 225 aa, Homo sapiens
MQRLLLLPFLLLGTVSALHLENDAPHLESLETQADLGQDLDSSKEQERDLALTEEVIQAEGEEVKASACQDNFEDEEAMESDPAALDKDFQCPREEDIVEVQGSPRCKTCRYLLVRTPKTFAEAQNVCSRCYGGNLVSIHDFNFNYRIQCCTSTVNQAQVWIGGNLRGWFLWKRFCWTDGSHWNFAYWSPGQPGNGQGSCVALCTKGGYWRRAQCDKQLPFVCSF

SEQ ID NO: 795273 - protein, 350 aa, Homo sapiens
MSKGLPETRTDAAMSELVPEPRPKPAVPMKPMSINSNLLGYIGIDTIIEQMRKKTMKTGFDFNIMVVGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPVSVDTEESHDSNP

SEQ ID NO: 795274 - protein, 350 aa, Homo sapiens; identical to SEQ ID NO: 795273

SEQ ID NO: 795275 - protein, 158 aa, Homo sapiens
MKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPVSVDTEESHDSNP

SEQ ID NO: 795276 - protein, 158 aa, Homo sapiens; identical to SEQ ID NO: 795275

SEQ ID NO: 795277 - protein, 358 aa, Homo sapiens
MSKGLPETRTDAAMSELVPEPRPKPAVPMKPMSINSNLLGYIGIDTIIEQMRKKTMKTGFDFNIMVVGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPGEGLLGTVLPPVPATPCPTAE

SEQ ID NO: 795278 - protein, 263 aa, Homo sapiens
MSKGLPETRTDAAMSELVPEPRPKPAVPMKPMSINSNLLGYIGIDTIIEQMRKKTMKTGFDFNIMVVAEEPIEKYINEQYEKFLKEEVNIARKKRIPDTRVHCCLYFISPTGHSLRPLDLEFMKHLSKVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPGEGLLGTVLPPVPATPCPTAE

SEQ ID NO: 795279 - protein, 350 aa, Homo sapiens; identical to SEQ ID NO: 795273

SEQ ID NO: 795280 - protein, 103 aa, Homo sapiens
RKYLQTMHPTKDEYPESTRRYFICLLPAAGLHTLNRSQPPCREKASWALSFHLCQPPPAPLLNEGHFKRCFSLHSSQLLLLQGQALFSAVLVQLTTTAPLSPQ

SEQ ID NO: 795281 - protein, 350 aa, Homo sapiens; identical to SEQ ID NO: 795273

SEQ ID NO: 795282 - protein, 90 aa, Homo sapiens
MKLTVIDTPGFGDQINNENWYLSASEIFALKTLLGRYLLWCRFIHVENHLHPPCSVVPDSPGQGPWGAPPLLTNHPGKPSVRGLRGNLAA

SEQ ID NO: 795283 - protein, 1939 aa, Homo sapiens
MSSDSEMAIFGEAAPFLRKSEKERIEAQNKPFDAKTSVFVVDPKESYVKAIVQSREGGKVTAKTEAGATVTVKEDQVFSMNPPKYDKIEDMAMMTHLHEPAVLYNLKERYAAWMIYTYSGLFCVTVNPYKWLPVYNPEVVTAYRGKKRQEAPPHIFSISDNAYQFMLTDRENQSILITGESGAGKTVNTKRVIQYFATIAVTGEKKKEEPASGKMQGTLEDQIISANPLLEAFGNAKTVRNDNSSRFGKFIRIHFGATGKLASADIETYLLEKSRVTFQLKAERSYHIFYQILSNKKPELIEMLLITTNPYDFAFVSQGEITVPSIDDQEELMATDSAVDILGFTADEKVAIYKLTGAVMHYGNMKFKQKQREEQAEPDGTEVADKAAYLTSLNSADLLKSLCYPRVKVGNEFVTKGQTVQQVYNAVGALAKAIYEKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYEQHLGKSNNFQKPKPAKGKPEAHFSLVHYAGTVDYNIAGWLDKNKDPLNETVVGLYQKSAMKTLAFLFSGAQTAEAEGGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIEIDHTQYKFGHTKVFFKAGLLGTLEEMRDEKLAQLITRTQAICRGFLMRVEFRKMMERRESIFCIQYNIRAFMNVKHWPWMKLYFKIKPLLKSAETEKEMANMKEEFEKTKEELAKTEAKRKELEEKMVTLMQEKNDLQLQVQAEADALADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQMEEDKVNTLTKAKTKLEQQVDDLEGSLEQEKKLCMDLERAKRKLEGDLKLAQESTMDTENDKQQLNEKLKKKEFEMSNLQGKIEDEQALAMQLQKKIKELQARIEELEEEIEAERASRAKAEKQRSDLSRELEEISERLEEAGGATSAQIELNKKREAEFQKMRRDLEESTLQHEATAAALRKKHADSVAELGKQIDSLQRVKQKLEKEKSELKMEINDLASNMETVSKAKANFEKMCRTLEDQLSEIKTKEEEQQRLINELSAQKARLHTESGEFSRQLDEKDAMVSQLSRGKQAFTQQIEELKRQLEEETKAKSTLAHALQSARHDCDLLREQYEEEQEAKAELQRGMSKANSEVAQWRTKYETDAIQRTEELEEAKKKLAQRLQDAEEHVEAVNSKCASLEKTKQRLQNEVEDLMIDVERSNAACIALDKKQRNFDKVLAEWKQKYEETQAELEASQKESRSLSTELFKVKNAYEESLDHLETLKRENKNLQQEISDLTEQIAEGGKHIHELEKVKKQLDHEKSELQTSLEEAEASLEHEEGKILRIQLELNQVKSEIDRKIAEKDEELDQLKRNHLRVVESMQSTLDAEIRSRNDALRIKKKMEGDLNEMEIQLNHANRQAAEALRNLRNTQGILKDTQLHLDDAIRGQDDLKEQLAMVERRANLMQAEVEELRASLERTERGRKMAEQELLDASERVQLLHTQNTSLINTKKKLETDISQIQGEMEDIVQEARNAEEKAKKAITDAAMMAEELKKEQDTSAHLERMKKNMEQTVKDLQLRLDEAEQLALKGGKKQIQKLEARVRELESEVESEQKHNVEAVKGLRKHERRVKELTYQTEEDRKNILRLQDLVDKLQTKVKAYKRQAEEAEEQSNVNLAKFRKLQHELEEAEERADIAESQVNKLRVKSREVHTKVISEE

SEQ ID NO: 795284 - protein, 154 aa, Homo sapiens
MKKNMEQTVKDLQLRLDEAEQLALKGGKKQIQKLEARVRELESEVESEQKHNVEAVKGLRKHERRVKELTYQTEEDRKNILRLQDLVDKLQTKVKAYKRQAEEAEEQSNVNLAKFRKLQHELEEAEERADIAESQVNKLRVKSREVHTKVISEE

SEQ ID NO: 795285 - protein, 99 aa, Homo sapiens
MTPPELDAASPAQGKHPDGCLIPYTQILYPPGTRRSRPRASLQKEFAQHNQFSRSVHPTISDSSLKAVEPRTKDAMGSVSAKTLAAGSAAHLGFKPRLL

SEQ ID NO: 795286 - protein, 107 aa, Homo sapiens
VVFQRSLTPFHKKKRGQNPRETPAGLQELGCMKPPRCQGCVLRQLACLGNTQPLPYPWLSFPAEPRTGVCVGKQGHLVHTGSQHAREESQAWVCSDCVLQFSDILDL

SEQ ID NO: 795287 - protein, 130 aa, Homo sapiens
MTNRKTTSTCPLPYGRRSYDSRNNETLNPLKFYKSSLCQTQRGVAARCQREEHVDCRCQRSPVRVPCFLSVPGRPQLVAKSSCRFPVCAPTLPVSRQKRRRPGEKQTPLIGLRLAAQLCPSLPQATCPRP

SEQ ID NO: 795288 - protein, 90 aa, Homo sapiens
SSQRGGGIEFSRSPQPRSPWAVAVAAAAPARQPIGSWARSARGGRWAERRARSEVVGFVRAGSMGSLLSVGSWKRWSLERLMRYLIHPAN

SEQ ID NO: 795289 - protein, 70 aa, Homo sapiens
GCRARAAPPEGRQGLTTESAGASSREEGRAARAEVVGFVRAGSMGSLLSVGSWKRWSLERLMRYLIHPAN

SEQ ID NO: 795290 - protein, 121 aa, Homo sapiens
GARALVQHFGWGAGFSHGPTPAFPFGFGEACARPHPWQQCLSPSQEGLGKTAPQHPIQAGLPSPRENGLWIEGDKLDFMTLNGGGLRGGAKPGGLQDHTTHFSKETEGQELGKAGPLFFFL

SEQ ID NO: 795291 - protein, 211 aa, Homo sapiens
DGGRYPDMPTAADVVNALDQQALASILRTYGEEKHAKKIASAIVQARSIYPITRTQQLASIVAGAFPPSAIYTRKDLLQRSTHIATKTFQALRIFVNNELNELYTGLKTAQKFLRPGGRLVALSFHSLEDRIVKRFLLGISMTERFNLSVRQQVMKTSQLGSDHENTEEVSMRRAPLMWELIHKKVLSPQDQDVQDNPRGRSAKLRAAIKL

SEQ ID NO: 795292 - protein, 268 aa, Homo sapiens
ARPRNLRLGTRPGCPGRAGLDMLPDCLSAEGELRCRRLLAGATARLRARPASAAVLVPLCSVRGVPALLYTLRSSRLTGRHKGDVSFPGGKCDPADQDVVHTALRETREELGLAVPEEHVWGLLRPVYDPQKATVVPVLAGVGPLDPQSLRPNSEEVELGDMRGLGCSSPLSTLSASCLQVDEVFALPLAHLLQTQNQGYTHFCRGGHFRYTLPVFLHGPHRVWGLTAVITEFALQLLAPGTYQPRLAGLTCSGAEGLARPKQPLASP

SEQ ID NO: 795293 - protein, 244 aa, Homo sapiens
ARPRNLRLGTRPGCPGRAGLDMLPDCLSAEGELRCRRLLAGATARLRARPASAAVLVPLCSVRGVPALLYTLRSSRLTGRHKGDVSFPGGKCDPADQDVVHTALRETREELGLAVPEEHVWGLLRPVYDPQKATVVPVLAGVGPLDPQSLRPNSEEVDEVFALPLAHLLQTQNQGYTHFCRGGHFRYTLPVFLHGPHRVWGLTAVITEFALQLLAPGTYQPRLAGLTCSGAEGLARPKQPLASP

SEQ ID NO: 795294 - protein, 465 aa, Homo sapiens
ARPRNLRLGTRPGCPGRAGLDMLPDCLSAEGELRCRRLLAGATARLRARPASAAVLVPLCSVRGVPALLYTLRSSRLTGRHKGDVRYSGRELLALCRRLQEPGAGRDLWQGTSAPSSLGFRLRKMGLGRVPPPKGCSESQRSVSVGPGAPAGAPRPRRVGPSYASLRARLGRDTPLSCFPLRGGAAPAGDYGEVRAPPAGIKNILEDNVSVAGATIGRIWVSEPQDLLAPAADPLILRCPGPLFLIPIAQGGKLASRGRMACLGPPSKLGAEAGDTSVGQWPPPHCRYPDLSVAPRVQGPDSLCLFSFPGGKCDPADQDVVHTALRETREELGLAVPEEHVWGLLRPVYDPQKATVVPVLAGVGPLDPQSLRPNSEEVDEVFALPLAHLLQTQNQGYTHFCRGGHFRYTLPVFLHGPHRVWGLTAVITEFALQLLAPGTYQPRLAGLTCSGAEGLARPKQPLASP

SEQ ID NO: 795295 - protein, 468 aa, Homo sapiens
MLPDCLSAEGELRCRRLLAGATARLRARPASAAVLVPLCSVRGVPALLYTLRSSRLTGRHKGDVRYSGRELLALCRRLQEPGAGRDLWQGTSAPSSLGFRLRKMGLGRVPPPKGCSESQRSVSVGPGAPAGAPRPRRVGPSYASLRARLGRDTPLSCFPLRGGAAPAGDYGEVRAPPAGIKNILEDNVSVAGATIGRIWVSEPQDLLAPAADPLILRCPGPLFLIPIAQGGKLASRGRMACLGPPSKLGAEAGDTSVGQWPPPHCRYPDLSVAPRVQGPDSLCLFSFPGGKCDPADQDVVHTALRETREELGLAVPEEHVWGLLRPVYDPQKATVVPVLAGVGPLDPQSLRPNSEEVELGDMRGLGCSSPLSTLSASCLQVDEVFALPLAHLLQTQNQGYTHFCRGGHFRYTLPVFLHGPHRVWGLTAVITEFALQLLAPGTYQPRLAGLTCSGAEGLARPKQPLASP

SEQ ID NO: 795296 - protein, 145 aa, Homo sapiens
RCRSAAPQAGRVARAAPSPSQLSEGPGLSAPPRLAPPLPSPDPAPSVSRRAGLDMLPDCLSAEGELRCRRLLAGATARLRARPASAAVLVPLCSVRGVPALLYTLRSSRLTGRHKGDVRYSGRELLALCRRLQEPGAGRDLWQGT

SEQ ID NO: 795297 - protein, 93 aa, Homo sapiens
LRAAGIRYERHFTPAWVTVETPSHIEVIFFVKISIVLLSSSHSTKHLQGQSHDQPPAAAHSWLLVKSRITSLCLRDLFCKIRRLASIKRPLVL

SEQ ID NO: 795298 - protein, 395 aa, Homo sapiens [sequence omitted]

SEQ ID NO: 795299 - protein, 148 aa, Homo sapiens
GRTRPFFSSGTHLHPVCRWRPILEWIKSLERSRCLGRSIQGGMAEQLASSQRSVPCPLLPSIPVASELTGKLAFFFFFLKCSLAVLPRLVWNSWVQATLPPRPPESWGYRHEPLHPAETLLHTGSHPPRPQTPGLLLWEWLSGNDSSV

SEQ ID NO: 795300 - protein, 109 aa, Homo sapiens
NKPLGSKSPAGCTCGFPLSANSSLCSPSAPHFSKAKHLTVICSMLPVRFLYFYSPVCGLSLCGCGRGAGYFYFSGIFLLSWEDFHFLPSLSVLPFMGCSGHETTSPNPS

SEQ ID NO: 795301 - protein, 109 aa, Homo sapiens; identical to SEQ ID NO: 795300

SEQ ID NO: 795302 - protein, 107 aa, Homo sapiens
MKQEWSQGYRALPSLSNHGSQNGLDLGDLLSLPPGTSMSSNSVSNSLPSYLFGTESSHSPYPSPRHSSTRSHSARSKKRALSLSPLSDGIGIDFNTIIRTSPTSLVA

SEQ ID NO: 795303 - protein, 173 aa, Homo sapiens
MVQRLGLISPPASQVSTACNQISPSLQRAMNAANLNIPPSDTRSLISRESLASTTLSLTESQSASSMKQEWSQGYRALPSLSNHGSQNGLDLGDLLSLPPGTSMSSNSVSNSLPSYLFGTESSHSPYPSPRHSSTRSHSARSKKRALSLSPLSDGIGIDFNTIIRTSPTSLVA

SEQ ID NO: 795304 - protein, 158 aa, Homo sapiens
RQQERASGKRGSQPTCVGCSQLPRDLSPGRPWEEKAPSQRLPGRRNPAQEELPGARPGSPPQASRLASPPLPSSCGVCLQPSLDSHAGLTLQRCATALQKPDDSARAGMKCDPAREGGRPLRFGSGRASSLGSGLGLAELRGSLLRAGLLHHLPRVAK

SEQ ID NO: 795305 - protein, 119 aa, Homo sapiens
VKVHSECACVSTGDFTAEEPEAENNFMTLPCSDLAESEPGVSLFFHMTPFTEKFTEELFRGKQPLLAFAYFSLTSLHPGRLSTPLHPTLPHPFPGRSCQSSWAESMNELEFSFNHCLLK

SEQ ID NO: 795306 - protein, 452 aa, Homo sapiens
MLACLQRTQNAPGQHLACPSKSLELRKCEAVASAMHSSRYPSPAELDAYAEKVANSPLSIKIFPTNIRVPQHKHLSRTVNGYDTSGQRYSPYPQHTAGYQGLLAIVKAAVSSSSTAAPAGPAKSVLKSAEGKRTKLSPAAVQVGIAPYPVPSTLGPLAYPKPPEAPAPPPGLPAAATAASVIPLPGRGLPLPPSNLPSIHSLLYQLNQQCQAPGAAPPACQGMAIPHPSPAKHGPVPSFPSMAYSAAAGLPDCRKGTELGQGATQALTLAGAAKPAGYADSGLDYLLWPQKPPPPPPQPLRAYSGSTVASKSPEACGGRAYERASGSPLNCGVGLPTSFTVGQYFAAPWNSVLVTPTSDCYNPAAAVVVTELGPGAARELAGPPADALSGLPSKSVCNTSVLSSSLQSLEYLINDIRPPCIKEQMLGKGYETVAVPRLLDHQHAHIRLPVYR

SEQ ID NO: 795307 - protein, 269 aa, Homo sapiens [sequence omitted]

SEQ ID NO: 795308 - protein, 297 aa, Homo sapiens
MSGEEPGPLRVRATPEGDNPSTSGRTRGLQAAGGRASERKQQRQAAAGAGEMVACVLPVCLPCCCVLEMCAALCELAAVCLMLAWPLMLWCPDVWMCCMLPPCLGLLADQLCATCAGQIAVLPLMLASVCWTPLITVWSVAVEPTLLETVSSLSPSATTDFPGSGDCHVPGADPSGIKRPVQAGNNGWAPILYTKSTVGERDRRSLRKDTPKGEQGALTVLRGGQGPHSLSQAQFFLCWTVVWSFFRGSKHGPAITGPGGQKLDWYHIAVMAYRRVLTANQRFVGIDAAPFYLRSKH

SEQ ID NO: 795309 - protein, 452 aa, Homo sapiens; identical to SEQ ID NO: 795306

SEQ ID NO: 795310 - protein, 370 aa, Homo sapiens
MLACLQRTQNAPGEAGRRTGWAARRGAQPHPVPADAHRGARLAAASLWPDGGWQGNLTYQGPSPPSVAPGHSEGLGAATDAHAFLYLSWQRQGERNHSKTGMVLSGPPGTGAQAKVGCRRKQAHQSQGGGRAAPPGVRQLCLPTLAPQYSGKGVQEADRKSLGPKCLPTSQVKTTLTEAPGTIPVPLFLLPLPPPFLPNTELHPHPHSPNPGLPYSPFPPIHLIGLLGTVVQAVHCTRAPCPRRHHFHPNLYIYYNFLHLEEGASFSCSHKGTTGANSGPAILDPILAFFEGSLGTLLVLTGRPRPTPFLQTTLQGLSHTIKAGKDRQESPHEVLKSWPLWRSGSGTVSLSKAWSSTKCIYKSLRMFFLY

SEQ ID NO: 795311 - protein, 105 aa, Homo sapiens [sequence omitted]

SEQ ID NO: 795312 - protein, 52 aa, Homo sapiens
MNVSQCLAQNRHLINICLMISKLSIVGLMRSQHLLSISFVAHASSLQHLLDL

SEQ ID NO: 795313 - protein, 169 aa, Homo sapiens
MKTSFSYFSDWHPTNLTLSDETCQRSKNLKVDDKCPSVSPSMPENQSATKELGQMNLTEREKMDTGVVLLSGNDTLHDLCQSQLPENKESKEAEQDLELTSEEEQERLKGCENKQPQKTSQEPEMAKDCDREDIPIYPVLPHVQKSEEMWIEQGKLEWKNQLKLVINEL

SEQ ID NO: 795314 - protein, 306 aa, Homo sapiens
RAPRQVQSPLPPNVFSPARLPFFPAEGGPGRSRWREGGYLSQSRSGRLSQEEAAARSAGGMAGAPDERRRGPAAGEQLQQQHVSCQVFPERLAQGNPQQGFFSSFFTSNQKCQLRLLKTLETNPYVKLLLDAMKHSGCAVNKDRHFSCEDCNGNVSGGFDASTSQIVLCQNNIHNQAHMNRVVTHELIHAFDHCRAHVDWFTNIRHLACSEVRAANLSGDCSLVNEIFRLHFGLKQHHQTCVRDRATLSILAVRNISKEVAKKAVDEVFESCFNDHEPFGRIPHNKTYARYAHRDFENRDRYYSNI

SEQ ID NO: 795315 - protein, 306 aa, Homo sapiens; identical to SEQ ID NO: 795314

SEQ ID NO: 795316 - protein, 71 aa, Homo sapiens
FSSFFTSNQKCQLRLLKTLETSRSHDLEAVVPQNGSETGWARKGLGNTWPGASGSAQSLDRLGIMGAGLGA

SEQ ID NO: 795317 - protein, 75 aa, Homo sapiens
HLPPEEFQSLPQGCGVEPRASRVDQVLPLSRTRRLSPAMQLSCSRCLSLRNRETAMSIVDSRSSLGDRVKRHLKK

SEQ ID NO: 795318 - protein, 114 aa, Homo sapiens [sequence omitted]

SEQ ID NO: 795319 - protein, 77 aa, Homo sapiens
MATSRGASRCPRDIANVMQRLQDEQEIVQKRTFTKWINSHLAKRKPPMVVDDLFEDMKDGVKLLALLEVLSGQKLVR

SEQ ID NO: 795320 - protein, 163 aa, Homo sapiens
TWACLICTAPIGGRSPHPILQGRTPGTERQEHRPRSHSQTLWGSRIGTQAAWPQSQHSLCSFRSLCLAAPPSSSSPLSSSHSNQPFLGTPQSEAVSRHIPQPPQSLGLTSLPRQESMARSQLTATSTSQAEAEESLEPRRQRLQGAKNMPLHSSLGNRARLCL

SEQ ID NO: 795321 - protein, 140 aa, Homo sapiens
TWACLICTAPIGGRSPHPILQGRTPGTERQEHRPRSHSQTLWGSRIGTQAAWPQSQHSLCSFRSLCLAAPPSSSSPLSSSHSNQPFLGTPQSEAVSRHIPQPPQSLGLTSLPRQESMARSQLTATSTSQVQEILLPQPPK

SEQ ID NO: 795322 - protein, 301 aa, Homo sapiens
VYLPTTFFFLPLLPSTLLLSFSSSSLYFLLFLVFFLFFLLCFFFFFSSSSSPPPASPPASSPPRVLELPGVPAAAFSDVLNFIYSARLALPGGGGDGAAVAEIGALGRRLGISRLQGLGEGGDAWVPPTPAPMATSQPEEDSFGPGPRPAGEWEGDRAEAQAPDLQCSLPRRPLPCPQCGKSFIHPKRLQTHEAQCRRGASTRGSTGLGAGGAGPGGPAGVDASALPPPVGFRGGPEHVVKVVGGHVLYVCAACERSYVTLSSLKRHSNVHSWRRKYPCRYCEKVFALAEYRTKHEVWHTG

SEQ ID NO: 795323 - protein, 172 aa, Homo sapiens
WGLGVTPRRCRQWDEEAFYPHPPQPLTSRSPRSFRKVDTGTDPVDTLTQTRRRVGLACTQDRKTSRWPGNFFQAKPESSPDTAARRPFCLLARPGPECAPAGKRKRPTAICCEEYIRSQTVDLFSPARSKTTSLRSCAPLRKVQMKELIPLDLSSCSEWRKNIYHPFHQSSA

SEQ ID NO: 795324 - protein, 109 aa, Homo sapiens
WGLGVTPRRCRQWDEEAFYPHPPQPLTSRSPRSFRKVDTGTDPVDTLTQTRRRVGLACTQDRKTSRWPGNFFQAKPESSPDTAARRPFCLLARPGPECAPAGREELRAV

SEQ ID NO: 795325 - protein, 109 aa, Homo sapiens; identical to SEQ ID NO: 795324

SEQ ID NO: 795326 - protein, 107 aa, Homo sapiens
QSQTLAEESISQNLGEEKRPRQGLRVPKQPLKLQELPQKGCYKPRLTTNIRTILLGEGQITGWGDWRRIVCIKDPHISGAFHQSVMCDVYSFILPTLGGLVFIIRKI

SEQ ID NO: 795327 - protein, 81 aa, Homo sapiens
MGSTQFELPSSFAYTVVVKPPAQASATADAPPPTKRHRPRWISDCCCAGSENFKPVDLTFLGSMGVGTAEPDHLAPWLQAP

SEQ ID NO: 795328 - protein, 157 aa, Homo sapiens
FRPVDGLFLNILESLGEREVCSSVGHLCITNTESTASGAWTRSGKSAFFWMPPAFAIICLGGWKLLKRLKEKSLFLLQLIWSYVMCSPSEVSRKLCAVFCPGNNTPAPWPRCIISHSSSLLSMAPEVKSSEMPKLPDVNIFTAWRKPHRSYLTCLGW

SEQ ID NO: 795329 - protein, 136 aa, Homo sapiens
CGRDGEDEQGFYTRRQKGTSAKENENTRPGEAAGMRAVVVLRGRFERVRPLGSWSQAWEKLLHVRPGAVALATSTPPGNPPPRGLSLPRPGPGGAHGSRDLPNNPCRWLHKPQPVLQPGMPFPPGCLLLSLLSLDN

SEQ ID NO: 795330 - protein, 367 aa, Homo sapiens
QRESWVLRERKVVVIDTPDLFSSIACAEDKQRNIQHCLELSAPSLHALLLVIAIGHFTREDEETAKGIQQVFGAEARRHIIIVFTRKDDLGDDLLQDFIEKNKPLKQLVQDYEGRYCIFNNKTNSKDEQITQVLELLRKVESLVNTNGGPYHVNFKTEGSRFQDCVNEAASQEGDKPQGPRERQLQSTGPEQNPGTSELTVLLVGKRGAGKSAAGNSILGRQAFQTGFSEQSVTQSFLSESRSWRKKKVSIIDAPDISSLKNIDSEVRKHICTGPHAFLLVTPLGFYTKNDEAVLSTIQNNFGEKFFEYMIILLTRKEDLGDQDLDTFLRNSNKALYGLIQKCKNRYSAFNYRATGEEEQRQADELL

SEQ ID NO: 795331 - protein, 398 aa, Homo sapiens
MSEQSCQMSELRLLLLGKCRSGKSATGNAILGKHVFKSKFSDQTVIQTPDLFSSIACAEDKQRNIQHCLELSAPSLHALLLVIAIGHFTREDEETAKGIQQVFGAEARRHIIIVFTRKDDLGDDLLQDFIEKNKPLKQLVQDYEGRYCIFNNKTNSKDEQITQVLELLRKVESLVNTNGGPYHVNFKTEGSRFQDCVNEAASQEGDKPQGPRERQLQSTGPEQNPGTSELTVLLVGKRGAGKSAAGNSILGRQAFQTGFSEQSVTQSFLSESRSWRKKKVSIIDAPDISSLKNIDSEVRKHICTGPHAFLLVTPLGFYTKNDEAVLSTIQNNFGEKFFEYMIILLTRKEDLGDQDLDTFLRNSNKALYGLIQKCKNRYSAFNYRATGEEEQRQADELL

SEQ ID NO: 795332 - protein, 147 aa, Homo sapiens
QTPLHTQPRSCLPGLLTAEPPLPAGRAKAKPPGGPRGSRRQHSPHRTRRFHRGAAANRATYSPHPRGRFAPAQVAASASNSQNPPRRRLPFADFGPGAWALPRGWEPGNRFLDLSGARKSAPPARLDWSGRVPWRPLGIAVLAQVER

SEQ ID NO: 795333 - protein, 97 aa, Homo sapiens
SKTSLPRPRAGARPGRGLSSRPGTTPLPTLHSLPKGLEKREEEHQDPPPRHVTRRNADEKTQDSETIKVTEMKLTEPEFQVMILYGFFGAALDLSSD

SEQ ID NO: 795334 - protein, 147 aa, Homo sapiens; identical to SEQ ID NO: 795332

SEQ ID NO: 795335 - protein, 147 aa, Homo sapiens; identical to SEQ ID NO: 795332

SEQ ID NO: 795336 - protein, 97 aa, Homo sapiens; identical to SEQ ID NO: 795333

SEQ ID NO: 795337 - protein, 171 aa, Homo sapiens
MEVCQKLQDALKCQHCRKQFKSKAGLNYHTMAEHSAKPSDAEASEGGEQEERERLRKVLKQMGRLRCPQEGCGAAFSSLMGYQYHQRRCGKPPCEVDSPSFPCTHCGKTYRSKAGHDYHVRSEHTAPPHRESVDALSVGSWAGPRVPKLCAAWGLSTASSCPAVVRLSAAK

SEQ ID NO: 795338 - protein, 1043 aa, Homo sapiens
PPAPARPGPAAAPLGAAEMTDPFCVGGRRLPGSSKSGPGKDGSRKEVRLPMLHDPPKMGMPVVRGGQTVPGQAPLCFDPGSPASDKTEGKKKGRPKAENQALRDIPLSLMNDWKDEFKAHSRVKCPNSGCWLEFPSIYGLKYHYQRCQGGAISDRLAFPCPFCEAAFTSKTQLEKHRIWNHMDRPLPASKPGPISRPVTISRPVGVSKPIGVSKPVTIGKPVGVSKPIGISKPVSVGRPMPVTKAIPVTRPVPVTKPVTVSRPMPVTKAMPVTKPITVTKSVPVTKPVPVTKPITVTKLVTVTKPVPVTKPVTVSRPIVVSKPVTVSRPIAISRHTPPCKMVLLTRSENKAPRATGRNSGKKRAADSLDTCPIPPKQARPENGEYGPSSMGQSSAFQLSADTSSGSLSPGSRPSGGMEALKAAGPASPPEEDPERTKHRRKQKTPKKFTGEQPSISGTFGLKGLVKAEDKARVHRSKKQEGPGPEDARKKVPAAPITVSKEAPAPVAHPAPGGPEEQWQRAIHERGEAVCPTCNVVTRKTLVGLKKHMEVCQKLQDALKCQHCRKQFKSKAGLNYHTMAEHSAKPSDAEASEGGEQEERERLRKVLKQMGRLRCPQEGCGAAFSSLMGYQYHQRRCGKPPCEVDSPSFPCTHCGKTYRSKAGHDYHVRSEHTAPPPEEPTDKSPEAEDPLGVERTPSGRVRRTSAQVAVFHLQEIAEDELARDWTKRRMKDDLVPETARLNYTRPGLPTLNPQLLEAWKNEVKEKGHVNCPNDCCEAIYSSVSGLKAHLASCSKGAHLAGKYRCLLCPKEFSSESGVKYHILKTHAENWFRTSADPPPKHRSQDSLVPKKEKKKNLAGGKKRGRKPKERTPEEPVAKLPPRRDDWPPGCRDKGARGSTGRKVGVSKAPEEVSMVRGAWPPCSRHTALCSRQGQLRDLCPPVLHPPPPPLHPSSGAASHSPFPEGGPSPVKAATGHTWVGAPQGVPSRSAIARRVAPPHGNVSGVLVPQGLQRRVGRWPLAPRLRFLRPCRVPSLATPRLRHPW

SEQ ID NO: 795339 - protein, 175 aa, Homo sapiens
PEDARKKVPAAPITVSKEAPAPVAHPAPGRGCLAGAQGSSRRRVDPTAQGWGLSVELDSVPGVWATQQPPQAFEAPALPTGGPEEQWQRAIHERGEAVCPTCNVVTRKTLVGLKKHMEVCQKVRQLPEGAGREAPWPQAGFSHVGHLQLQDALKCQHCRKQFKSKAGLNYHTMAE

SEQ ID NO: 795340 - protein, 92 aa, Homo sapiens
VTKPVPVTKPITVTKLVTVTKPVPVTKPVTVSRPIVVSKPVTVSRPIAISRHTPPCKMVLLTRSENKAPRATGRNSGKKRYGGSSQVGEEQW

SEQ ID NO: 795341 - protein, 1043 aa, Homo sapiens; identical to SEQ ID NO: 795338

SEQ ID NO: 795342 - protein, 1043 aa, Homo sapiens; identical to SEQ ID NO: 795338

SEQ ID NO: 795343 - protein, 241 aa, Homo sapiens
AVSSPAAGACLVLKAVSSPAAGACLVLKAVSSPAAGACLVLKAVSSPAAGACLVLKAVSSPLLQVLAWSRRLCPALLQVLAWSRRLCPALLQVLAWSRRLCPAPCRCLPGPEGCVQPPAAGACLVLKAVSSPAAGACLVLKADRSSALRLCLAQVLSIQSQVFISAFLSPELVPNISRPTSQTQEPGLIGAQEGKEEKSGRWKEAGPKAQGADPRGACGQAAPAPGRLASRMQRQGGPGLH

SEQ ID NO: 795344 - protein, 134 aa, Homo sapiens
ENFLKSSISSIMPPTTARPAPQSWAARRDTAPHTSFTTMLSSHVLSRPSCCRILLTWRRASRSLQAIEQGVRTCFPGPRDVPSVTHSLPILRCPYRREEKLTQAMARLEQNALEAETQEGPPPLEVPSTLKNKV

SEQ ID NO: 795345 - protein, 111 aa, Homo sapiens
NGALEIVVVIPKAWKKEVFSGPRPVFWPVTVALQCLELRWFFLGVEPGNRDFPAMFCVLLAGEGWLTNSDPAQCFCGSKLENYVQARPRRKDPFRPGVKELPGQHGATPSL

SEQ ID NO: 795346 - protein, 111 aa, Homo sapiens; identical to SEQ ID NO: 795345

SEQ ID NO: 795347 - protein, 111 aa, Homo sapiens; identical to SEQ ID NO: 795345

SEQ ID NO: 795348 - protein, 137 aa, Homo sapiens
MLKRHLGVGRPTREEQQQETVTPPPPYQWGCSQGWRNKGREPRTWTAQGSWSHEADGLTARAATQIWRSGGIPRLLFFLCPPSSSRTFHWVKLIRSQLARGSGACDLPSKILSRTQARNRCDTNQTNDQDTDLSRAA

SEQ ID NO: 795349 - protein, 88 aa, Homo sapiens
ERERSSGDGPQGLRAGGRGSVESGERSSGDDPQRRLAKCGCASPPCPRRKLSHSKGRPEGSAGRLCTDTCPPRGSPPAPGPCRLVLRV

SEQ ID NO: 795350 - protein, 101 aa, Homo sapiens
PSQQKRIRRCPQEGDALPGPPALPQTAPGLTAESVSYIQCHLRVAPNTWLACWPPTTLSATLAALWFLSRLLKGRPLWMLSSTLSKCPHPHPSNIKLMVVP

SEQ ID NO: 795351 - protein, 1241 aa, Homo sapiens
MALGTTLRASLLLLGLLTEGLAQLAIPASVPRGFWALPENLTVVEGASVELRCGVSTPGSAVQWAKDGLLLGPDPRIPGFPRYRLEGDPARGEFHLHIEACDLSDDAEYECQVGRSEMGPELVSPRVILSILVPPKLLLLTPEAGTMVTWVAGQEYVVNCVSGDAKPAPDITILLSGQTISDISANVNEGSQQKLFTVEATARVTPRSSDNRQLLVCEASSPALEAPIKASFTVNVLFPPGPPVIEWPGLDEGHVRAGQSLELPCVARGGNPLATLQWLKNGQPVSTAWGTEHTQAVARSVLVMTVRPEDHGAQLSCEAHNSVSAGTQEHGITLQVTFPPSAIIILGSASQTENKNVTLSCVSKSSRPRVLLRWWLGWRQLLPMEETVMDGLHGGHISMSNLTFLARREDNGLTLTCEAFSEAFTKETFKKSLILNVKYPAQKLWIEGPPEGQKLRAGTRVRLVCLAIGGNPEPSLMWYKDSRTVTESRLPQESRRVHLGSVEKSGSTFSRELVLVTGPSDNQAKFTCKAGQLSASTQLAVQFPPTNVTILANASALRPGDALNLTCVSVSSNPPVNLSWDKEGERLEGVAAPPRRAPFKGSAAARSVLLQVSSRDHGQRVTCRAHSAELRETVSSFYRLNVLYRPEFLGEQVLVVTAVEQGEALLPVSVSANPAPEAFNWTFRGYRLSPAGGPRHRILSSGALHLWNVTRADDGLYQLHCQNSEGTAEARLRLDVHYAPTIRALQDPTEVNVGGSVDIVCTVDANPILPGMFNWERLGEDEEDQSLDDMEKISRGPTGRLRIHHAKLAQAGAYQCIVDNGVAPPARRLLRLVVRFAPQVEHPTPLTKVAAAGDSTSSATLHCRARGVPNIVFTWTKNGVPLDLQDPRYTEHTYHQGGVHSSLLTIANVSAAQDYALFTCTATNALGSDQTNIQLVSISRPDPPSGLKVVSLTPHSVGLEWKPGFDGGLPQRFCIRYEALGTPGFHYVDVVPPQATTFTLTGLQPSTRYRVWLLASNALGDSGLADKGTQLPITTPGLHQPSGEPEDQLPTEPPSGPSGLPLLPVLFALGGLLLLSNASCVGGVLWQRRLRRLAEGISEKTEAGSEEDRVRNEYEESQWTGERDTQSSTVSTTEAEPYYRSLRDFSPQLPPTQEEVSYSRGFTGEDEDMAFPGHLYDEVERTYPPSGAWGPLYDEVQMGPWDLHWPEDTYQDPRGIYDQVAGDLDTLEPDSLPFELRGHLV

SEQ ID NO: 795352 - protein, 1241 aa, Homo sapiens; identical to SEQ ID NO: 795351

SEQ ID NO: 795353 - protein, 1201 aa, Homo sapiens
MALGTTLRASLLLLGLLTEGLAQLAIPASVPRGFWALPENLTVVEGASVELRCGVSTPGSAVQWAKDGLLLGPDPRIPGFPRYRLEGDPARGEFHLHIEACDLSDDAEYECQVGRSEMGPELVSPRVILSILVPPKLLLLTPEAGTMVTWVAGQEYVVNCVSGDAKPAPDITILLSGQTISDISANVNEGSQQKLFTVEATARVTPRSSDNRQLLVCEASSPALEAPIKASFTVNVLFPPGPPVIEWPGLDEGHVRAGQSLELPCVARGGNPLATLQWLKNGQPVSTAWGTEHTQAVARSVLVMTVRPEDHGAQLSCEAHNSVSAGTQEHGITLQVTFPPSAIIILGSASQTENKNVTLSCVSKSSRPRVLLRWWLGWRQLLPMEETVMDGLHGGHISMSNLTFLARREDNGLTLTCEAFSEAFTKETFKKSLILNVKYPAQKLWIEGPPEGQKLRAGTRVRLVCLAIGGNPEPSLMWYKDSRTVTESRLPQESRRVHLGSVEKSGSTFSRELVLVTGPSDNQAKFTCKAGQLSASTQLAVQFPPTNVTILANASALRPGDALNLTCVSVSSNPPVNLSWDKEGERLEGVAAPPRRAPFKGSAAARSVLLQVSSRDHGQRVTCRAHSAELRETVSSFYRLNVLYRPEFLGEQVLVVTAVEQGEALLPVSVSANPAPEAFNWTFRGYRLSPAGGPRHRILSSGALHLWNVTRADDGLYQLHCQNSEGTAEARLRLDVHYAPTIRALQDPTEVNVGGSVDIVCTVDANPILPGMFNWERLGEDEEDQSLDDMEKISRGPTGRLRIHHAKLAQAGAYQCIVDNGVAPPARRLLRLVVRFAPQVEHPTPLTKVAAAGDSTSSATLHCRARGVPNIVFTWTKNGVPLDLQDPRYTEHTYHQGGVHSSLLTIANVSAAQDYALFTCTATNALGSDQTNIQLVSISRPDPPSGLKVVSLTPHSVGLEWKPGFDGGLPQRFCIRYEALGTPGFHYVDVVPPQATTFTLTGLQPSTRYRVWLLASNALGDSGLADKGTQLPITTPGLHQPSGEPEDQLPTEPPSGISEKTEAGSEEDRVRNEYEESQWTGERDTQSSTVSTTEAEPYYRSLRDFSPQLPPTQEEVSYSRGFTGEDEDMAFPGHLYDEVERTYPPSGAWGPLYDEVQMGPWDLHWPEDTYQDPRGIYDQVAGDLDTLEPDSLPFELRGHLV

SEQ ID NO: 795354 - protein, 104 aa, Homo sapiens
PSRHEGCSSLVPHPLLRGLRTNWFFFQTWTVCLVGHPRAGPLHAVDAASCEAQSLRDFASQRYLQFKVMSPAYSQGHLKGTRPSSIPFSEAVTQGWKLMLLPSL

SEQ ID NO: 795355 - protein, 38 aa, Homo sapiens
MVSTVNKAQATQWGCQSQGGESNSLQSQATPIPAFRAW

SEQ ID NO: 795356 - protein, 122 aa, Homo sapiens
NPSVLRRWNELMCTLGIGMTSSPNERSRLSGKRSRRETRAEQCVAARVEEEKRSQWSRFPASLAKRESRAGGGEREELMIILNFSSFPMVLKSPPLKSRYKILARQFHFKSSRGGGHPGSQN

SEQ ID NO: 795357 - protein, 107 aa, Homo sapiens
EGMAGDQSDPEQRPARMSALDPLREKARVTHRRKTKQPKLPGCTGGPKSPEGRRKPETARAGQTLLRPMQIRPTHATWKSGLGSQKTKHMRAGLHERRRRRRLRGSS

SEQ ID NO: 795358 - protein, 93 aa, Homo sapiens
AQYSQVIGGPLEGHFYKKPVAFIVGTLSAHSPREGAARYCSTAERPNGKEPRPASDPPVGLETNFPFFSQAEPSAEVTAMANHLQPPGRLEPR

SEQ ID NO: 795359 - protein, 290 aa, Homo sapiens
MGTAGAKGLSGQQEGHAGPPSCQQHVDHGSRHGDGHSCRFLRILTTVPAECCMNIHMELNQAWAGGWHRERRRDRLGPGPSGHTLAGCGRKSPPAPARICLPRDGTGLGLLYGHRQKRPMSDMTSPLSDCPRPGSPDAGAGLLPERPREVHLRFNGGTAASEARQWVVRSLSSLGSAAEEDWPPRPRPGTGMLGGHGQSSREPLAPWACPQLSRRERFFPTPVADALVKGFAEREHMDFQFFPAGARRPAPSLSSLGRTRVLLDPWPRSLRWAALHPFPPSKGGPWTPLT

SEQ ID NO: 795360 - protein, 238 aa, Homo sapiens [sequence omitted]

SEQ ID NO: 795361 - protein, 262 aa, Homo sapiens
MPKHCFLGFLISFFLTGVAGTQSTHESLKPQRVQFQSRNFHNILQWQPGRALTGNSSVYFVQYKIMFSCSMKSSHQKPSGCWQHISCNFPGCRTLAKYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 795362 - protein, 129 aa, Homo sapiens
MPKHCFLGFLISFFLTGVAGTQSTHESLKPQRVQFQSRNFHNILQWQPGRALTGNSSVYFVQYKIYGQRQWKNKEDCWGTQELSCDLTSETSDIQEPYYGRVRAASAGSYSEWSMTPRFTPWWERAKGL

SEQ ID NO: 795363 - protein, 230 aa, Homo sapiens
MPKHCFLGFLISFFLTGVAGTQSTHESLKPQRVQFQSRNFHNILQWQPGRALTGNSSVYFVQYKIYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 795364 - protein, 230 aa, Homo sapiens; identical to SEQ ID NO: 795363

SEQ ID NO: 795365 - protein, 69 aa, Homo sapiens
SRPVQAFQTVAAPSSRCLSSLVAARPTRAATMTRMMSEQTAPHWWTGWVRTRWSSKARWACTTVINLRS

SEQ ID NO: 795366 - protein, 1982 aa, Homo sapiens
MAADDDNGDGTSLFDVFSASPLKNNDEGSLDIYAGLDSAVSDSASKSCVPSRNCLDLYEEILTEEGTAKEATYNDLQVEYGKCQLQMKELMKKFKEIQTQNFSLINENQSLKKNISALIKTARVEINRKDEEISNLHQRLSEFPHFRNNHKTARTFDTVKTKDLKSRSPHLDDCSKTDHRAKSDVSKDVHHSTSLPNLEKEGKPHSDKRSTSHLPTSVEKHCTNGVWSRSHYQVGEGSSNEDSRRGRKDIRHSQFNRGTERVRKDLSTGCGDGEPRILEASQRLQGHPEKYGKGEPKTESKSSKFKSNSDSDYKGERINSSWEKETPGERSHSRVDSQSDKKLERQSERSQNINRKEVKSQDKEERKVDQKPKSVVKDQDHWRRSERASLPHSKNEITFSHNSSKYHLEERRGWEDCKRDKSVNSHSFQDGRCPSSLSNSRTHKNIDSKEVDAMHQWENTPLKAERHRTEDKRKREQESKEENRHIRNEKRVPTEHLQKTNKETKKTTTDLKKQNEPKTDKGEVLDNGVSEGADNKELAMKAESGPNETKNKDLKLSFMKKLNLTLSPAKKQPVSQDNQHKITDIPKSSGVCDSESSMQVKTVAYVPSISEHILGEAAVSEHTMGETKSTLLEPKVALLAVTEPRIGISETNKEDENSLLVRSVDNTMHCEEPICGTETSFPSPMEIQQTESLFPSTGMKQTINNGRAAAPVVMDVLQTDVSQNFGLELDTKRNDNSDYCGISEGMEMKVALSTTVSETTESILQPSIEEADILPIMLSEDNNPKFEPSVIVTPLVESKSCHLEPCLPKETLDSSLQQTELMDHRMATGETNSVYHDDDNSVLSIDLNHLRPIPEAISPLNSPVRPVAKVLRNESPPQVPVYNNSHKDVFLPNSAHSTSKSQSDLNKENQKPIYKSDKCTEADTCKNSPLDELEEGEIRSDSETSKPQESFEKNSKRRVSADVRKSKTIPRRGKSTVCLDKDSRKTHVRIHQTNNKWNKRPDKSSRSSKTEKKDKVMSTSSLEKIVPIIAVPSSEQEIMHMLRMIRKHVRKNYMKFKAKFSLIQFHRIIESAILSFTSLIKHLNLHKISKSVTTLQKNLCDIIESKLKQVKKNGIVDRLFEQQLPDMKKKLWKFVDDQLDYLFAKLKKILVCDSKSFGRDSDEGKLEKTSKQNAQYSNSQKRSVDNSNRELLKEKLSKSEDPVHYKSLVGCKKSEENYQDQNNSSINTVKHDIKKNFNICFDNIKNSQSEERSLEVHCPSTPKSEKNEGSSIEDAQTSQHATLKPERSFEILTEQQASSLTFNLVSDAQMGEIFKSLLQGSDLLDSSVNCTEKSEWELKTPEKQLLETLKCESIPACTTEELVSGVASPCPKMISDDNWSLLSSEKGPSLSSGLSLPVHPDVLDESCMFEVSTNLPLSKDNVCSVEKSKPCVSSILLEDLAVSLTVPSPLKSDGHLSFLKPDMSSSSTPEEVISAHFSEDALLEEEDASEQDIHLALESDNSSSKSSCSSSWTSRSVAPGFQYHPNLPMHAVIMEKSNDHFIVKIRRATPSTSSGLKQSMMPDELLTSLPRHGKEADEGPEKEYISCQNTVFKSVEELENSNKNVDGSKSTHEEQSSMIQTQVPDIYEFLKDASDKMGHSDEVADECFKLHQVWETKVPESIEELPSMEEISHSVGEHLPNTYVDLTKDPVTETKNLGEFIEVTVLHIDQLGCSGGNLNQSAQILDNSLQADTVGAFIDLTQDASSEAKSEGNHPALAVEDLGCGVIQVDEDNCKEEKAQVANRPLKCIVEETYIDLTTESPSSCEVKKDELKSEPGSNCDNSELPGTLHNSHKKRRNISDLNHPHKKQRKETDLTNKEKTKKPTQDSCENTEAHQKKASKKKAPPVTKDPSSLKATPGIKDSSAALATSTSLSAKNVIKKKGEIIILWTRNDDREILLECQKRGPSFKTFAYLAAKLDKNPNQVSERFQQLMKLFEKSKCR

SEQ ID NO: 795367 - protein, 1982 aa, Homo sapiens; identical to SEQ ID NO: 795366

SEQ ID NO: 795368 - protein, 108 aa, Homo sapiens
YRYLWWQGGLVGIFYLPFLSNGKALLTPGKSDPGRGYGAPRCPPELPITTGASLLPCCMSALSLSCLLIALVLVWGGECQVSLVSHLSSIIHNLKHFFLFWGLSTFAH

SEQ ID NO: 795369 - protein, 388 aa, Homo sapiens
MEETNSSSKDMYQSPGEAEGWRWKKGSDRGQNLFRKHSKCLILLIRERFESPHSYICSPVTFQFFYAQSVKHVNVTIDCLPEGAATRGTARTSKPTTKSQKTLPSTSPGHWTQSTPWASALRSSPWTETAAPSETEETLNTGRPPELPARATATWFSASHTLPALATRRVARTQWLTADRQTWASISSVPWAQTISEKKPGGSLWETRSSPPTTAGTEEAMNTTSLLAPAAEIMATPGSPSQASPTSGAFTHGTQTPSPTKATAPRYPQTGDLSAEWPFTAGEEPVLVPRPHQVSRCPQPLFKVGAMAAAPLTLAIQRLNPCLMELCQFFQQCLCMSQRSPRTEDMRYCLEYYSWFLKNATYICQRVKRVSHSHTLKQKCLENICKSV

SEQ ID NO: 795370 - protein, 115 aa, Homo sapiens
MWGAQGTAGQASPWTSRNQNQTAQGPRGEDVSADGQPRLIMASSGSLSVPGERGRWQTGKEATCWDAETRLQELLELAEVTAGTTVASWSLHSPSFHPRVPVTPPKCAHETYEET

SEQ ID NO: 795371 - protein, 158 aa, Homo sapiens
TVTLTKYIPLWTSDTMTELEQTTLLILSNQIIFGKEKRSYGKTPYIKEIIAVLPSLGHLTALTSFCRTLGSEEFVDFQQGPRMRKTASPAHLRAAEQGHAKSSFGSTRKLLPWHLGEEWVIIKCPVSLEKLYSSLKLLPFERTFIRVFSHYNSNIRSL

SEQ ID NO: 795372 - protein, 454 aa, Homo sapiens
MESILGSASCTEPSSALEVNSPPSQPPQPVVPAKPVQCVHHVSTQPSCPGRGKMSKLLNPEEMTSRDYYFDSYAHFGIHEEMLKDEVRTLTYRNSMYHNKHVFKDKVVLDVGSGTGILSMFAAKAGAKKVFGVPSPFLKAWPEASETPSVPLCEYFSREWSLPEAWGQSEGPPSVEIECSSISDYSEKIIKANHLDNIITIFKGKVEEVELPVEKVDIIISEWMGYCLFYESMLNTVIFARDKWLKPGGLMFPDRAALYVVAIEDRQYKDFKIHWLLGNKWPAERRKKNLIPWVICALNDVKVGQSSCGDKTQINPYKGWENVYGFDMTCIRDVAMKEPLVDIVDPKQVVTNACLIKIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 795373 - protein, 394 aa, Homo sapiens
MGMKHSSRCLLLRRKMAENAAESTEVNSPPSQPPQPVVPAKPVQCVHHVSTQPSCPGRGKMSKLLNPEEMTSRDYYFDSYAHFGIHEEMLKDEVRTLTYRNSMYHNKHVFKDKVVLDVGSGTGILSMFAAKAGAKKVFGIECSSISDYSEKIIKANHLDNIITIFKGKVEEVELPVEKVDIIISEWMGYCLFYESMLNTVIFARDKWLKPGGLMFPDRAALYVVAIEDRQYKDFKIHWWENVYGFDMTCIRDVAMKEPLVDIVDPKQVVTNACLIKEVDIYTVKTEELSFTSAFCLQIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 795374 - protein, 2353 aa, Homo sapiens
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRSTFPSPEAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQHCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 795375 - protein, 734 aa, Homo sapiens [sequence omitted]

SEQ ID NO: 795376 - protein, 119 aa, Homo sapiens
LTPECPITRPSRETPQKPQPCTLARQPHTEKYRRTPASGARPTSGGRRPLTRPPGRKMTANRDAALSSHRHPGCAQRPRTPTFASSSQRRSAFGFDDGNFPGLGERSHAPGSRLGARRR

SEQ ID NO: 795377 - protein, 151 aa, Homo sapiens
MTCSDLLLPELTRFKVTDETHMEIFLGWVGQLEDRVFTPERGLENFTQSRCSLLRTPADASQWTLRCIPRVQRVSRLPLEIQHIFFLKEETDGRQEAKRRGRKGIGRRGRKGKGRKRKESELEILQGLKVKKHVSQLSQKIKELLQGQVTG

SEQ ID NO: 795378 - protein, 139 aa, Homo sapiens
SSLPSQPLDPSNWAWNSTFTESSTSDFQMQDTQWERLVASVPALYSDAYDIFQIIELYNLPDENEISSSSFHCLYQYLSPTKYQVGGQGSSLSIFAGPAVGLSPAQTWPNMTSQAFEAYSLTDSLEFQKTSNMVDLGFL

SEQ ID NO: 795379 - protein, 58 aa, Homo sapiens
MDVQEPLWDSDLGQEPQIISRGSALRATRYSRGNRKLMSSFLFWLVLFCYVPQQQKAF

SEQ ID NO: 795380 - protein, 79 aa, Homo sapiens
QGCFARNRWGIRKKPVAGKASADAAFFSCTHPWEGAVRWPGRTRSWTPQNERLTLHRNILGQQAQHILNFEYEQSKLQG

SEQ ID NO: 795381 - protein, 755 aa, Homo sapiens
TFIVTHSTLDSFRRMGLKVIQQNVHKFLQLRFWGWWKLYNKVKPLLNVARQEEEMKAKEEELRKAMAQTQELVNKVKELEEKTATLSQEKNDLTIQLQAEQENLMDAEERLTWMMKTKMDLESQISDMRERLEEEEGMAASLSAAKRKLEGELSDLKRDLEGLETTLAKTEKEKQALDHKVRTLTGDLSLREDSITKLQKEKRALEELHQKTLDDLQAEEDKVNHLTKNNSKLSTQIHELEDNWEQEKKIRAEVEKARRKAESDLKMTIDNLNEMERSKLDLEEVVKKRDLEINSVNSKYEDEQSLNSTLQRKLKEHQDRIEELEEELEAERAMRAKIEQNRKREAELLKLRRELEEAALQSEATASTLRKKHVDSMAELTEHVESLQRVKSKLEKDKQVMKAEIDDLNASMETIQKSKMNAEAHVRKLEDSLSEANAKVAELERNQAEINAIRTRLQAENSELSREYEESQSRLNQILRIKTSLTSQVDDYKRQLDEESKSRSTAVVSLANTKHDLDLVKEQLEEEQGGKSELQRLVSKLNTEVTTWRTKYETDAIQRTEELEETKRKLAARLQEAEEAAETAQARAASLEKNKQRLQAEVEDLTIDLEKANAAAAALDKKQRLFDKMLAEWQQKCEELQVEVDSSQKECRMYMTESFKIKTAYEESLEHLESVKKENKTLQEEIKDLIDQLGEGGRSVHELQKLKKKLEMEKEELQVALEEAESSLEVEESKVIRIQLELAQVKADIDRRIHE

SEQ ID NO: 795382 - protein, 263 aa, Homo sapiens
TFIVTHSTLDSFRRMGLKVIQQNVHKFLQLRFWGWWKLYNKVKPLLNVARQEEEMKAKEEELRKAMAQTQELVNKVKELEEKTATLSQEKNDLTIQLQAEQENLMDAEERLTWMMKTKMDLESQISDMRERLEEEEGMAASLSAAKRKLEGELSDLKRDLEGLETTLAKTEKEKQALDHKVRTLTGDLSLREDSITKLQKEKRALEELHQKTLDDLQAEEDKVNHLTKNNSKLSTQIHEVIPIAVATSTTPRPDPSGGTGSED

SEQ ID NO: 795383 - protein, 107 aa, Homo sapiens
ERGCPRQPRGKEGKRERDRDPPSWPTTLRRGKLAVHAQDPASDQAQQAQAGHVECGALQAAPTQNLGQPASAACSPGSHLCLSLHTSLRAEGVGSSLGQPQRGAPTA

SEQ ID NO: 795384 - protein, 130 aa, Homo sapiens
MGGIGSQQATVECAPACEVAAGPRSHNHANARCVVAKEMGLELPAPRPRAWSAGRVAGVGPGDSEAEWLRPPHAKAPRASPPVRNTWNMFPSHVTPRDASETCRARRHHREPGPRRTPLISCSCKYIQFS

SEQ ID NO: 795385 - protein, 131 aa, Homo sapiens
QTPEKRHKSCPGGLHFLSRSINLHFPKLSISGTYKLKRVLRNLGITKIFSNEADLSGVSQEAPLKLSKAVHVAVLTIDEKGTEATGPPHLEEKAWSKYQTVMFNRPFLVIIKDDITNFPLFIGKVVNPTQK

SEQ ID NO: 795386 - protein, 314 aa, Homo sapiens
GSCSSHCPAQSLPYPTMLVGTPNLLTLDEADATWTLIKDKVIEEHFGPNAVAVPFLSDAACYDLLGVLVKQSRPAHTRLALPGRQGRRALKPVGPLPSLLEQAGSEGAFAHCTREYSPNGRAERAYEETRMLDGQPCKIRLHMGDLRKKVAFLLLPPGQVSLQQTLPWLRSTHSIYVIYQVFSCSWLQLGLTSTAREPQLLRLLRSLPVAFSCLKFSLQSKGVLGPQKPLTKDPLPHGANWVRPNLSIMPPLAPTSASADTTEAADVPPPVPAPPTPPPQEGPEDKPTRFSYKGRNPFWRGPQILSGSILRVRQ

SEQ ID NO: 795387 - protein, 112 aa, Homo sapiens
MYHLLVAMTEAIKMAGIKRLHLSTQLQSLKVTAFHSFPSPFIPGLRASISWRDPLALYFMRLKCKLSHSKPESIMGVLIHSFYLRLGSISKSYPIGFLSGELIALTFQNDIK

SEQ ID NO: 795388 - protein, 371 aa, Homo sapiens
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSDSLKSIRYKIVNFDPKLLEGKVKEDPDQGESMKPLTFARFYLPILVPSAKKAIYMDDDVIVQGDILALYNTALKPGHAAAFSEDCDSASTKVVIRGAGNQYNYIGYLDYKKERIRKLSMKASTCSFNPGVFVANLTEWKRQNITNQLEKWMKLNVEEGLYSRTLAGSITTPPLLIVFYQQHSTIDPMWNVRHLGSSAGKRYSPQFVKAAKLLHWNGHLKPWGRTASYTDVWEKWYIPDPTGKFNLIRRYTEISNIK

SEQ ID NO: 795389 - protein, 371 aa, Homo sapiens; identical to SEQ ID NO: 795388

SEQ ID NO: 795390 - protein, 371 aa, Homo sapiens; identical to SEQ ID NO: 795388

SEQ ID NO: 795391 - protein, 371 aa, Homo sapiens; identical to SEQ ID NO: 795388

SEQ ID NO: 795392 - protein, 371 aa, Homo sapiens; identical to SEQ ID NO: 795388

SEQ ID NO: 795393 - protein, 159 aa, Homo sapiens [sequence omitted]

SEQ ID NO: 795394 - protein, 266 aa, Homo sapiens
MPGSKSWLNSDSLKSIRYKIVNFDPKLLEGKVKEDPDQGESMKPLTFARFYLPILVPSAKKAIYMDDDVIVQGDILALYNTALKPGHAAAFSEDCDSASTKVVIRGAGNQYNYIGYLDYKKERIRKLSMKASTCSFNPGVFVANLTEWKRQNITNQLEKWMKLNVEEGLYSRTLAGSITTPPLLIVFYQQHSTIDPMWNVRHLGSSAGKRYSPQFVKAAKLLHWNGHLKPWGRTASYTDVWEKWYIPDPTGKFNLIRRYTEISNIK

SEQ ID NO: 795395 - protein, 68 aa, Homo sapiens
MSFRKVNIIILVLAVALFLLVLHHNFLSLSSLLRNEVTDSGFVGLEPITLAKCFHLLIWSKEKFCVFL

SEQ ID NO: 795396 - protein, 31 aa, Homo sapiens
MSFRKGKLIILVLALRLSSSRQLVHLPPTTD

SEQ ID NO: 795397 - protein, 371 aa, Homo sapiens; identical to SEQ ID NO: 795388

SEQ ID NO: 795398 - protein, 371 aa, Homo sapiens; identical to SEQ ID NO: 795388

SEQ ID NO: 795399 - protein, 371 aa, Homo sapiens; identical to SEQ ID NO: 795388

SEQ ID NO: 795400 - protein, 259 aa, Homo sapiens
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSDSLKSIRYKIVNFDPKLLEGKVKEDPDQGESMKPLTFARFYLPILVPSAKKAIYMDDDVIVQGDILALYNTALKPGHAAAFSEDCDSASTKVVIRGAGNQVNCLPNTPLPTILFNGKRLQIQGTLLLQFTLPNHFIPKLKPAFL

SEQ ID NO: 795401 - protein, 67 aa, Homo sapiens
SPTGRYSPCPRPAPSLGDVRFCRAVLPARAAEVVVAAALSRHRAPVKCSPSVLLGAWSRVPRPENCP

SEQ ID NO: 795402 - protein, 178 aa, Homo sapiens
GKNVLIVRREKTTSTPDCTPTYTDVISETLCSMKKRKDNLNQLYQHHWTEWNYFDKHLKELQDNFSREMKNIDPKAADTKKANHMFIPPSAVNEESPDKKTKGSLQREIEFKGCSNKNHGKGRSVNMRGKEEREREEKQKLNISFHSLPSPEELHNLEPGSAYRIRDISATRWSGTRK

SEQ ID NO: 795403 - protein, 424 aa, Homo sapiens
FQRPLNSMNNQKSVWGEVKMDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKKNGSTVKIPMMKALLRTKYGYFSESSLNYQVLELSYKGDEFSLIIILPAEGMDIEEVEKLITAQQILKWLSEMQEEEVEISLPRFKVEQKVDFKDVLYSLNITEIFSGGCDLSGITDSSEVYVSQVTQKVFFEINEDGSEAATSTGIHIPVIMSLAQSQFIANHPFLFIMKHNPTESILFMGRVTNPDTQEIKGRDLDSL

SEQ ID NO: 795404 - protein, 424 aa, Homo sapiens; identical to SEQ ID NO: 795403

SEQ ID NO: 795405 - protein, 405 aa, Homo sapiens
MDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKKNGSTVKIPMMKALLRTKYGYFSESSLNYQVLELSYKGDEFSLIIILPAEGMDIEEVEKLITAQQILKWLSEMQEEEVEISLPRFKVEQKVDFKDVLYSLNITEIFSGGCDLSGITDSSEVYVSQVTQKVFFEINEDGSEAATSTGIHIPVIMSLAQSQFIANHPFLFIMKHNPTESILFMGRVTNPDTQEIKGRDLDSL

SEQ ID NO: 795406 - protein, 454 aa, Homo sapiens
FQRPLNSMNNQKSVWEDPVLIGLFIRLFSLSITLCFLIRYDPKPDGEVKMDTIFLWSLLLLFFGSQASRCSAQKNTEFAVDLYQEVSLSHKDNIIFSPLGITLVLEMVQLGAKGKAQQQIRQTLKQQETSAGEEFFVLKSFFSAISEKKQEFTFNLANALYLQEGFTVKEQYLHGNKEFFQSAIKLVDFQDAKACAEMISTWVERKTDGKIKDMFSGEEFGPLTRLVLVNAIYFKGDWKQKFRKEDTQLINFTKKNGSTVKIPMMKALLRTKYGYFSESSLNYQVLELSYKGDEFSLIIILPAEGMDIEEVEKLITAQQILKWLSEMQEEEVEISLPRFKVEQKVDFKDVLYSLNITEIFSGGCDLSGITDSSEVYVSQVTQKVFFEINEDGSEAATSTGIHIPVIMSLAQSQFIANHPFLFIMKHNPTESILFMGRVTNPDTQEIKGRDLDSL

SEQ ID NO: 795407 - protein, 386 aa, Homo sapiens
MLLPKKMKLLLFLVSQMAILALFFHMYSHNISSLSMKAQPERMHVLVLSSWRSGSSFVGQLFGQHPDVFYLMEPAWHVWMTFKQSTAWMLHMAVRDLIRAVFLCDMSVFDAYMEPGPRRQSSLFQWENSRALCSAPACDIIPQDEIIPRAHCRLLCSQQPFEVVEKACRSYSHVVLKEVRFFNLQSLYPLLKDPSLNLHIVHLVRDPRAVFRSRERTKGDLMIDSRIVMGQHEQKLKKEDQPYYVMQVICQSQLEIYKTIQSLPKALQERYLLVRYEDLARAPVAQTSRMYEFVGLEFLPHLQTWVHNITRGKGMGDHAFHTNARDALNVSQAWRWSLPYEKVSRLQKACGDAMNLLGYRHVRSEQEQRNLLLDLLSTWTVPEQIH

SEQ ID NO: 795408 - protein, 386 aa, Homo sapiens; identical to SEQ ID NO: 795407

SEQ ID NO: 795409 - protein, 386 aa, Homo sapiens; identical to SEQ ID NO: 795407

SEQ ID NO: 795410 - protein, 416 aa, Homo sapiens
GQKGNRRQTIKQQPNSTLSVCSLKVFHFSTMLLPKKMKLLLFLVSQMAILALFFHMYSHNISSLSMKAQPERMHVLVLSSWRSGSSFVGQLFGQHPDVFYLMEPAWHVWMTFKQSTAWMLHMAVRDLIRAVFLCDMSVFDAYMEPGPRRQSSLFQWENSRALCSAPACDIIPQDEIIPRAHCRLLCSQQPFEVVEKACRSYSHVVLKEVRFFNLQSLYPLLKDPSLNLHIVHLVRDPRAVFRSRERTKGDLMIDSRIVMGQHEQKLKKEDQPYYVMQVICQSQLEIYKTIQSLPKALQERYLLVRYEDLARAPVAQTSRMYEFVGLEFLPHLQTWVHNITRGKGMGDHAFHTNARDALNVSQAWRWSLPYEKVSRLQKACGDAMNLLGYRHVRSEQEQRNLLLDLLSTWTVPEQIH

SEQ ID NO: 795411 - protein, 416 aa, Homo sapiens; identical to SEQ ID NO: 795410

SEQ ID NO: 795412 - protein, 181 aa, Homo sapiens
MDKEKLDVKIEYCNYAMDSSVENMYVNKVWVQCENENCLKWRLLSSEDSAKVDHDEPWYCFMNTDSRYNNCSISEEDFPEESQLHQCGFKIVYSQLPLGSLVLVKLQNWPSWPGILCPDRFKGKYVTYDPDGNVEEYHIEFLGDPHSRSWIKATFVGHYSITLKIMRSMTYIHMLLQTYKK

SEQ ID NO: 795413 - protein, 141 aa, Homo sapiens
PAAAGAAPRLSPQAARCTALSTEKPDRPRPPRRPPAPTPVSAPTLRSAPLDAHRLRERLPESSVGPRAEPARRSRNAAMVSPRHQPATFTRETNRTRSSECRGAEARTARSDLAWRTDSLTKPERRQQCVCGKGSGSQNTK

SEQ ID NO: 795414 - protein, 68 aa, Homo sapiens
KPPPGYVYRVPAPMVIPPKKGAPFVVFCSRSRPRPRIRGSVDYGCEKTDRRGLLSAVDYFWKGFSERF

SEQ ID NO: 795415 - protein, 77 aa, Homo sapiens
MQLLPPSSERSRPPGATALEVTSEQWGEGKQGAGRGFAEQQEQRPCRCLVWWPGGASHFLRPLLFSDLRKTMCGFPK

SEQ ID NO: 795416 - protein, 68 aa, Homo sapiens
GHEAEGYGTFPGRERISENARLPQCSSSDAARGYQKFWHLHLHASPWPPPPQDGLASTGGLDVNLCRG

SEQ ID NO: 795417 - protein, 87 aa, Homo sapiens
PAVARSRFNSIGFSADNHNHENAQNGSMNGTIKRPKRWTLAQKLTSQKGQWPAEPWAQLLRIAIGPRVSIPPASTLDLATSSLPWIP

SEQ ID NO: 795418 - protein, 127 aa, Homo sapiens
CLLIDLRMKSRFTKEFLSPLGPGPFFSLIILPAPILRVTGTSRREDILFPYNVLKSLSRSSLFLTKRSSEYSSAHSHRQNRPGPDIVSILEAAMPPITTPTKGATTLTSKYRLFLSVVVLYIKMYAL

SEQ ID NO: 795419 - protein, 102 aa, Homo sapiens
MVPRKQIAAVRSAGLQLIKHPVGNTQLGTHCLCSLLKQSPLFHTGSSAVLSYRPWLSFPSLDDVDPHLVLVPALPYSNIDGLLLAIYTALFHFTSSCLTPKC

SEQ ID NO: 795420 - protein, 115 aa, Homo sapiens [sequence omitted]

SEQ ID NO: 795421 - protein, 73 aa, Homo sapiens
FSKAVLVSEQCICNLENACDSAAQLALQTSPDAPFSALGPASYLQNAAGERAAKAGGLVTQDMEVPLDPGNSN

SEQ ID NO: 795422 - protein, 161 aa, Homo sapiens
CFLLLPFMLLVHLPSPQPGMKSPHVLVFLCLLVALVTGNLVQFGVMIEKMTGKSALQYNDYGCYCGIGGSHWPVDQTDWCCHAHDCCYGRLEKLGCEPKLEKYLFSVSERGIFCAGRTTCQRLTCECDKRAALCFRRNLGTYNRKYAHYPNKLCTGPTPPC

SEQ ID NO: 795423 - protein, 75 aa, Homo sapiens
QRAAGSPLRPGFVVPAPGEGCAGRRGAEGLRATGFKPRVAEARQPREWIAGAVWERRQVPRTQSLQTASGIEGVA

SEQ ID NO: 795424 - protein, 125 aa, Homo sapiens
MRPRCCILALVCWITVFLLQCSKGTTDAPVGSGLWLCQPTPRCGNKIYNPSEQCCYDDAILSLKETRRCGSTCTFWPCFELCCPESFGPQQKFLVKLRVLGMKSQCHLSPISRSCTRNRRHVLYP

SEQ ID NO: 795425 - protein, 74 aa, Homo sapiens
GSNTQKYTRQDMQSGPWSIDPKWKAKWSPIHGEHCGCLHILHAYHCFHTAMRRNGLQLPAAPEGVGSEDAEEGA

SEQ ID NO: 795426 - protein, 21 aa, Homo sapiens
MGKSDGARSDPSENEEFQVVM

SEQ ID NO: 795427 - protein, 395 aa, Homo sapiens
GTRSSWAHGIGRGRFGRVMTDDESESVLSDSHEGSELELPVIQLCGLVEELSYVNSALKTETEMFEKYYAKLEPRDQRPPRLSEIKISAADYAQFRGRRRSKSRTGMDRGVGLTADQKLELVQKEVADMKDDLRHTRANAERDLQHHEAIIEEAEIRWSEVSREVHEFEKDILKAISKKKGSILATQKVMKYIEDMNRRRDNMKEKLRLKNVSLKVQRKKMLLQLRQKEEVSEALHDVDFQQLKIENAQFLETIDARNQELTQLKLSSGNTLQVLNAYKSKLHKAMEIYLNLDKEILLRKELLEKIEKETLQVEEDRAKAEAVNKRLRKQLAEFRAPQVMTYVREKILNADLEKSIRMWERKVEIAEMSLKGHRKAWNRMKITNEQLQADYLAGK

SEQ ID NO: 795428 - protein, 326 aa, Homo sapiens
AVNRARSHLVTAIITKLNISSSYAQFRGRRRSKSRTGMDRGVGLTADQKLELVQKEVADMKDDLRHTRANAERDLQHHEAIIEEAEIRWSEVSREVHEFEKDILKAISKKKGSILATQKVMKYIEDMNRRRDNMKEKLRLKNVSLKVQRKKMLLQLRQKEEVSEALHDVDFQQLKIENAQFLETIDARNQELTQLKLSSGNTLQVLNAYKSKLHKAMEIYLNLDKEILLRKELLEKIEKETLQVEEDRAKAEAVNKRLRKQLAEFRAPQVMTYVREKILNADLEKSIRMWERKVEIAEMSLKGHRKAWNRMKITNEQLQADYLAGK

SEQ ID NO: 795429 - protein, 289 aa, Homo sapiens
MDRGVGLTADQKLELVQKEVADMKDDLRHTRANAERDLQHHEAIIEEAEIRWSEVSREVHEFEKDILKAISKKKGSILATQKVMKYIEDMNRRRDNMKEKLRLKNVSLKVQRKKMLLQLRQKEEVSEALHDVDFQQLKIENAQFLETIDARNQELTQLKLSSGNTLQVLNAYKSKLHKAMEIYLNLDKEILLRKELLEKIEKETLQVEEDRAKAEAVNKRLRKQLAEFRAPQVMTYVREKILNADLEKSIRMWERKVEIAEMSLKGHRKAWNRMKITNEQLQADYLAGK

SEQ ID NO: 795430 - protein, 102 aa, Homo sapiens
MGSKMASASRVVQVVKPHTPLIRFPDRRDNPKPNVSEALRSAGLPSHSSVISQHSKGSKSPDLLMYQGPPDTAEIIKTLPQKYRRKLVSQEEMEFIQRGGPE

SEQ ID NO: 795431 - protein, 353 aa, Homo sapiens
CYLQLKMERARRRGGGGGRGRGGKNVGGSGLSKSRLYPQAQHSHYPHYAASATPNQAGGAAEIQELASKRVDIQKKRFYLDVKQSSRGRFLKIAEVWIGRGRQDNIRKSKLTLSLSVAAELKDCLGDFIEHYAHLGLKGHRQEHGHSKEQGSRRRQKHSAPSPPVSVGSEEHPHSVLKTDYIERDNRKYYLDLKENQRGRFLRIRQTMMRGTGMIGYFGHSLGQEQTIVLPAQGMIEFRDALVQLIEDYGEGDIEERRGGDDDPLELPEGTSFRVDNKRFYFDVGSNKYGIFLKVSEVRPPYRNTITVPFKAWTRFGENFIKYEEEMRKICNSHKEKRMDGRKASGEEQECLD

SEQ ID NO: 795432 - protein, 102 aa, Homo sapiens
QIQKINEAKSWFFEKINKTDKPLARLTKKRREKIQITSLRNETEDITTEIQKIIQGYYEHLYAHKLENLEEMGKFPEKYRSLNQEELDTLNRPISSEIKVVI

SEQ ID NO: 795433 - protein, 372 aa, Homo sapiens
MKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 795434 - protein, 372 aa, Homo sapiens; identical to SEQ ID NO: 795433

SEQ ID NO: 795435 - protein, 372 aa, Homo sapiens; identical to SEQ ID NO: 795433

SEQ ID NO: 795436 - protein, 365 aa, Homo sapiens
MWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 795437 - protein, 180 aa, Homo sapiens
MKGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 795438 - protein, 236 aa, Homo sapiens
MKAGATSMWASCCGLLNEVMGTGAVRGQQSAFAGATGPFRFTPNPEFSTYPPAATEGPNIVCKACGLSFSVFRKKVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 795439 - protein, 323 aa, Homo sapiens
MKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSCRFIFSFFPCSIFP

SEQ ID NO: 795440 - protein, 216 aa, Homo sapiens
MKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVRGGN

SEQ ID NO: 795441 - protein, 103 aa, Homo sapiens [sequence omitted]

SEQ ID NO: 795442 - protein, 323 aa, Homo sapiens; identical to SEQ ID NO: 795439

SEQ ID NO: 795443 - protein, 373 aa, Homo sapiens
MRKAGATSMWASCCGLLNEVMGTGAVRGQQSAFAGATGPFRFTPNPEFSTYPPAATEGPNIVCKACGLSFSVFRKKHVCCDCKKDFCSVCSVLQENLRRCSTCHLLQETAFQRPQLMRLKVKDLRQYLILRNIPIDTCREKEDLVDLVLCHHGLGSEDDMDTSSLNSSRSQTSSFFTRSFFSNYTAPSATMSSFQGELMDGDQTSRSGVPAQVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 795444 - protein, 372 aa, Homo sapiens; identical to SEQ ID NO: 795433

SEQ ID NO: 795445 - protein, 163 aa, Homo sapiens
MKVQSEITSANTEDDDDDDDEDDDDEEENAEDRNPGLSKERVRASLSDLSSLDDVEGMSVRQLKEILARNFVNYSGCCEKWELVEKVNRLYKENEENQKSYGERLQLQDEEDDSLCRICMDAVIDCVLLECGHMVTCTKCGKRMSECPICRQYVVRAVHVFKS

SEQ ID NO: 795446 - protein, 406 aa, Homo sapiens
SRLVPALRCMDHRGPPSQPRGGAAAGALAVVGGQWAMLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRNCCVEPGTELSPTLPHQL

SEQ ID NO: 795447 - protein, 326 aa, Homo sapiens
MLGAVEGPRWKQAEDIRDIYDFRDVLGTIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRNCCVEPGTELSPTLPHQL

SEQ ID NO: 795448 - protein, 792 aa, Homo sapiens
MSSVSTESKLQQAVSLQGVDPETCMIVFKNHWAQVVKILEKHDPLKNTQAKYGSIPPDEASAVQNYVEHMLFLLIEEQAKDAAMGPILEFVVSENIMEKLFLWSLRREFTDETKIEQLKMYEMLVTQSHQPLLHHKPILKPLMMLLSSCSGTTTPTVEEKLVVLLNQLCSILAKDPSILELFFHTSEDQGAANFLIFSLLIPFIHREGSVGQQARDALLFIMSLSAENTMVAHHIVENTYFCPVLATGLSGLYSSLPTKLEEKGEEWHCLLKDDWLLLPSLVQFMNSLEFCNAVIQVAHPLIRNQLVNYIYNGFLVPVLAPALHKVTVEEVMTTTAYLDLFLRSISEPALLEIFLRFILLHQHENVHILDTLTSRINTPFRLCVVSLALFRTLIGLHCEDVMLQLVLRYLIPCNHMMLSQRWAVKERDCYSVSAAKLLALTPVCCSSGITLTLGNQERDYILWSKCMHDTSGPVERPFPEAFSESACIVEYGKALDISYLQYLWEAHTNILRCMRDCRVWSALYDGDSPDPEMFLQSLTEEGSVSSACPVFGLPQQLPRKTGPQLAPRKDKSQTELEWDDSYDTGISSGADVGSPGPYDDLEVSGPPAPIDPPKHIQEMKKNALLLFKGSYIEESDFQDDVMVYRLCAEKDSEDMKDSQEEAARPPAEAQAEVQSVPINNGPLLSTQPETDSEEEWNRDNSDPFHSEPKEPKQEREPEAAPESNSELASPAPEAEHSSNLTAAHPESEELIAQYDQIIKELDSGAEGLMEQNYPTPDPLLLTKEEEGKEESK

SEQ ID NO: 795449 - protein, 792 aa, Homo sapiens; identical to SEQ ID NO: 795448

SEQ ID NO: 795450 - protein, 1167 aa, Homo sapiens
SEQASAPLAKDKQIEELRQECHLLQARVASGPCSDLHTGRGGPCTQWLNVRDLDRLQRESQREVLRLQRQLMLQQGNGGAWPEAGGQSATCEEVRRQMLALERELDQRRRECQELGTQAAPARRRGEEAETQLQAALLKNAWLAEENGRLQAKTDWVRKVEAENSEVRGHLGRACQERDASGLIAEQLLQQAARGQDRQQQLQRDPQKALCDLHPSWKEIQALQCRPGHPPEQPWETSQMPESQVKGSRRPKFHARPEDYAVSQPNRDIQEKREASLEESPVALGESASVPQVSETVPASQPLSKKTSSQSNSSSEGSMWATVPSSPTLDRDTASEVDDLEPDSVSLALEMGGSAAPAAPKLKIFMAQYNYNPFEGPNDHPEGELPLTAGDYIYIFGDMDEDGFYEGELEDGRRGLVPSNFVEQIPDSYIPGCLPAKSPDLGPSQLPAGQDEALEEDSLLSGKAQGMVDRGLCQMVRVGSKTEVATEILDTKTEACQLGLLQSMGKQGLSRPLLGTKGVLRMAPMQLHLQNVTATSANITWVYSSHRHPHVVYLDDREHALTPAGVSCYTFQGLCPGTHYRVRVEVRLPWDLLQVYWGTMSSTVTFDTLLAGPPYPPLDVLVERHASPGVLVVSWLPVTIDSAGSSNGVQVTGYAVYADGLKVCEVADATAGSTVLEFSQLQVPLTWQKVSVRTMSLCGESLDSVPAQIPEDFFMCHRWPETPPFSYTCGDPSTYRVTFPVCPQKLSLAPPSAKASPHNPGSCGEPQAKFLEAFFEEPPRRQSPVSNLGSEGECPSSGAGSQAQELAEAWEGCRKDLLFQKSPQNHRPPSVSDQPGEKENCYQHMGTSKSPAPGFIHLRTECGPRKEPCQEKAALERVLRQKQDAQGFTPPQLGASQQYASDFHNVLKEEQEALCLDLWGTERREERREPEPHSRQGQALGVKRGCQLHEPSSALCPAPSAKVIKMPRGGPQQLGTGANTPARVFVALSDYNPLVMSANLKAAEEELVFQKRQLLRVWGSQDTHDFYLSECNRQVGNIPGRLVAEMEVGTEQTDRRWRSPAQGHLPSVAHLEDFQGLTIPQGSSLVLQGNSKRLPLWTPKIMIAALDYDPGDGQMGGQGKGRLALRAGDVVMVYGPMDDQGFYYGELGGHRGLVPAHLLDHMSLHGH

SEQ ID NO: 795451 - protein, 113 aa, Homo sapiens
MARRLLAMRRSHSCSAPSVPGVPSQATDLPLRKGIEQGVGGDLWGLGPGKWGSGRQNGAGVSAPPRPFLSALVTASLVSTLLTGFSFGLEWASDSCLPQPPSRTPGFSLFLVP

SEQ ID NO: 795452 - protein, 103 aa, Homo sapiens
SQGAMGISGVTKLWGPSRSLCSLLALPSSVELKQRIQLPKVGYGFLMRSCLIESRRTLSSSCPRPTPPPRLAVPVCCGVSPTPWEAPSSLSAPGSLQASFLQL

SEQ ID NO: 795453 - protein, 227 aa, Homo sapiens
TWGGYVGGRGSWFRNKRAGFRLLQPHRSLGPPLLLSASHILSVSLFYVYLCHFSAHFCFLSLCFMALISYCFLPFSLTSLLPIFLVSVSHLFLHLSVSVFSHSFSSLSASQSSFGLSSPHVFYFSFLLSFPSLFLTFISFLHIFSFTLFFVSYLPFSVPFIALCLPALHPLPCAACEVKGSADEKDRDTSPFFPLVRPLAHTPLYPSFLYLHKLQVELRKPPPSEAS

SEQ ID NO: 795454 - protein, 99 aa, Homo sapiens
MERAYPPRCGESRQPTDFSTRRRPPWQHLRIFTLGPCSFSSLKKISTLSRPGDETPPCMPASVQGMGLRQGEGSTAEQVGRHSRIRMKGDELDQSPRGF

SEQ ID NO: 795455 - protein, 212 aa, Homo sapiens
MAGPGPGPGDPDEQYDFLFKLVLVGDASVGKTCVVQRFKTGAFSERQGSTIGVDFTMKTLEIQGKRVKLQIWDTAGQERFRTITQSYYRSANGAILAYDITKRSSFLSVPHWIEDVRKYAGSNIVQLLIGNKSDLSELREVSLAEAQSLAEHYDILCAIETSAKDSSNVEEAFLRVATELIMRHGGPLFSEKSPDHIQLNSKDIGEGWGCGC

SEQ ID NO: 795456 - protein, 203 aa, Homo sapiens
MAGPGPGPGDPDEQYDFLFKLVLVGDASVGKTCVVQRFKTGAFSERQGSTIGVDFTMKTLEIQGKRVKLQIWDTAGQERFRTITQSYYRSANGAILAYDITKRSSFLSVPHWIEDVRKYAGSNIVQLLIGNKSDRSTHRHLPGVWLTALSGPLSFLTKNVASHFHQHSMGSRPTARWGHGPQLGGDCLLAQGPVFCHSGCKIS

SEQ ID NO: 795457 - protein, 188 aa, Homo sapiens
QLQQPGEALELCILWPGCGMEALLEEGEAGYPGGPPCQPAAGPPPSSHSKTGLNPPVWATVGGASSPPCPMPAGSDRFLSWVCFTCGSRLLLSRDVSSALGSSRSSWGSAQSSRARAMRPTDLVPERSSREAPAPSRRGTCFLPSLPPQHSQTSPWGLAHCLIRTSEFSDKKCSFSFSSAQHGVTAHS

SEQ ID NO: 795458 - protein, 32 aa, Homo sapiens
MGNKRRSLWRKVYVPAMGTLIVPEHSVEEAVL

SEQ ID NO: 795459 - protein, 124 aa, Homo sapiens
MLSCPTLGWFSWQTLALKCKSCTARSARTPSGPGQALTYMLGTHFSRQSSHPSGSPAQNGTLSKCQCLGRIHVRSWYNPGNFLWEMHECGTLLIALRVQSVACPASLHNPSVPWMAGARPDAPS

SEQ ID NO: 795460 - protein, 136 aa, Homo sapiens
PWQNLHTHSARGDGSSPRKERFRHPLFLPNVQHVIKLKHFSDCCMSFIDFQSTKIVVLVNFVQTYSCFLGRGFADFSHGCSWKYASTPSVSDSLDPGCNWRICIAQKRSVLQFLPHSLSCSCFHHVKCLLPHCLLP

SEQ ID NO: 795461 - protein, 308 aa, Homo sapiens
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 795462 - protein, 308 aa, Homo sapiens; identical to SEQ ID NO: 795461

SEQ ID NO: 795463 - protein, 249 aa, Homo sapiens
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 795464 - protein, 354 aa, Homo sapiens
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQIPMKLVTGITFAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 795465 - protein, 158 aa, Homo sapiens
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKPRITFRGMENKTEEGGT

SEQ ID NO: 795466 - protein, 193 aa, Homo sapiens
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQAIIRELGGIPIVANKINHSNQSIKEKALNALNNLSVNVENQIKIKPRITFRGMENKTEEGGT

SEQ ID NO: 795467 - protein, 308 aa, Homo sapiens; identical to SEQ ID NO: 795461

SEQ ID NO: 795468 - protein, 271 aa, Homo sapiens
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQIPMKLVTGITFAIIRELGGIPIVANKINHSNQSIKEKALNALNNLSVNVENQIKIKVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 795469 - protein, 249 aa, Homo sapiens; identical to SEQ ID NO: 795463

SEQ ID NO: 795470 - protein, 308 aa, Homo sapiens; identical to SEQ ID NO: 795461

SEQ ID NO: 795471 - protein, 308 aa, Homo sapiens; identical to SEQ ID NO: 795461

SEQ ID NO: 795472 - protein, 343 aa, Homo sapiens
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 795473 - protein, 284 aa, Homo sapiens
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQAIIRELGGIPIVANKINHSNQSIKEKALNALNNLSVNVENQIKIKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 795474 - protein, 284 aa, Homo sapiens
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 795475 - protein, 308 aa, Homo sapiens; identical to SEQ ID NO: 795461

SEQ ID NO: 795476 - protein, 191 aa, Homo sapiens
DRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 795477 - protein, 265 aa, Homo sapiens
MGGPRGAGWVAAGLLLGAGACYCIYRLTRGRRRGDRELGIRSSKSAEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFHDAEVKEKVVTIIPKI

SEQ ID NO: 795478 - protein, 43 aa, Homo sapiens
MLERSCSPATEQSWTENDFEELEKKASDDQITLSYGRTFKPKA

SEQ ID NO: 795479 - protein, 73 aa, Homo sapiens
HQASLTNASLIPRASSLKGLWLCSRVLFMSHYVGRMSQPSAGTGKDGKTGPFQEAEAKVWKITRPSSPIPSLG

SEQ ID NO: 795480 - protein, 472 aa, Homo sapiens
WRRSRPDRRGVGARAGAAVSQSTGSRAASVSVARRVEAGVSRAAGRMTPLCLNCSVLPGDLYPGGARNPMACNGSAARGHFDPEDLNLTDEALRLKYLGPQQTELFMPICATYLLIFVVGAVGNGLTCLVILRHKAMRTPTNYYLFSLAVSDLLVLLVGLPLELYEMWHNYPFLLGVGGCYFRTLLFEMVCLASVLNVTALSVERYVAVVHPLQARSMVTRAHVRRVLGAVWGLAMLCSLPNTSLHGIRQLHVPCRGPVPDSAVCMLVRPRALYNMVVQTTALLFFCLPMAIMSVLYLLIGLRLRRERLLLMQEAKGRGSAAARSRYTCRLQQHDRGRRQVTKMLFVLVVVFGICWAPFHADRVMWSVVSQWTDGLHLAFQHVHVISGIFFYLGSAANPVLYSLMSSRFRETFQEALCLGACCHRLRPRHSSHSLSRMTTGSTLCDVGSLGSWVHPLAGNDGPEAQQETDPS

SEQ ID NO: 795481 - protein, 67 aa, Homo sapiens
MCMNVPCKLVNAIKLEVLEIVGTDVLTKSALQSGFPIFIPHEGSVISERNDTGFLREARDLLGLPPH

SEQ ID NO: 795482 - protein, 65 aa, Homo sapiens
WPTVPQRRSVSGQSSPAQIPPLFPAPLGPGAPGTRALAPHTSAPLSAYSPQDASHMHIPQGHAVP

SEQ ID NO: 795483 - protein, 184 aa, Homo sapiens
MRGCGSRRLCGSWRGCWSWSGKPSTSSRPSPTAALRSWNNENKSALQLERQVKELKLGEPGSYQPAETAAKAQLSLMALPGEGYGGGHLDNEEEAPRPMLNIPGDLESREAMVAFFNSAGASAQEEQSVCCQPLAHPVASSQKKPEAAAPAPETGGESVCGDTHWALQEAMEKLQQLYGRRRWT

SEQ ID NO: 795484 - protein, 387 aa, Homo sapiens
WKESSMNIIELEIPDQNIDVDALQVAFGSLYRDDVLIKPSRVVAILAAACMLQLDGLIQQCGETMKETINVKTVCGYYTSVEIYGLDSVKKKCLEWLLNNLMTHQNVKLFKELSINVMKQLIGSSNLFVMQVEMDVYTTLKKWMFLQLVPSWNGSLKQLLTETDVWFSKQRKDFEGMAFLETEPGKPFVSVFRHLRLQYIISDLASARIIEQDGIVPSEWLSSVYKQQWFAMLRAEQDREVGPQEINKEDLEGSSMRCGRKLAKDGEYYWRWTGFNFGFDLLVIYTNRYIIFKRNTLNQPCSGSVSLQPRRSIAFRLRLASFDSSGKLVCSRTTGYQILILEKDQEQVVMNLDSRFLTFPLYICCNFLYISPEKGIENNRHPEDPEN

SEQ ID NO: 795485 - protein, 140 aa, Homo sapiens
MPSCLHSVSPTPEDQVSAAPLLARALHWGAKGWRPCRWPCPPWASRPLRGWPVLPITSLGQSHHLLSIKLPQRLRPPGLHQPSPLGSVCAGPHPHLWEETEAQEAVWLAGSLGSGPHCSPVKPLWEGSGSRWCPQSSLAC

SEQ ID NO: 795486 - protein, 110 aa, Homo sapiens
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 795487 - protein, 110 aa, Homo sapiens; identical to SEQ ID NO: 795486

SEQ ID NO: 795488 - protein, 110 aa, Homo sapiens; identical to SEQ ID NO: 795486

SEQ ID NO: 795489 - protein, 110 aa, Homo sapiens; identical to SEQ ID NO: 795486

SEQ ID NO: 795490 - protein, 110 aa, Homo sapiens; identical to SEQ ID NO: 795486

SEQ ID NO: 795491 - protein, 175 aa, Homo sapiens
FQGQDTILDYTLREVDTVKREPRAAPGQETWLLNSRKPSSPGGIEWLQSRVSSGINWMEGKISCRIRHEMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 795492 - protein, 110 aa, Homo sapiens; identical to SEQ ID NO: 795486

SEQ ID NO: 795493 - protein, 110 aa, Homo sapiens; identical to SEQ ID NO: 795486

SEQ ID NO: 795494 - protein, 110 aa, Homo sapiens; identical to SEQ ID NO: 795486

SEQ ID NO: 795495 - protein, 110 aa, Homo sapiens; identical to SEQ ID NO: 795486

SEQ ID NO: 795496 - protein, 110 aa, Homo sapiens; identical to SEQ ID NO: 795486

SEQ ID NO: 795497 - protein, 110 aa, Homo sapiens; identical to SEQ ID NO: 795486

SEQ ID NO: 795498 - protein, 110 aa, Homo sapiens; identical to SEQ ID NO: 795486

SEQ ID NO: 795499 - protein, 110 aa, Homo sapiens; identical to SEQ ID NO: 795486

SEQ ID NO: 795500 - protein, 110 aa, Homo sapiens; identical to SEQ ID NO: 795486

SEQ ID NO: 795501 - protein, 110 aa, Homo sapiens; identical to SEQ ID NO: 795486

SEQ ID NO: 795502 - protein, 110 aa, Homo sapiens; identical to SEQ ID NO: 795486

SEQ ID NO: 795503 - protein, 81 aa, Homo sapiens
WRAGGHCVSLTVSSCVPLPRRCSGTCSARHVLAVGQVELGGGPGAGSLQPLALEGSLQKRGIVEQCCTSICSLYQLENYCN

SEQ ID NO: 795504 - protein, 62 aa, Homo sapiens
MPAPNTTGAAPSSTQWCSPIPAPIRAAVTIAGGIVTAEDLNNYCAELIEHPLNISLGDAVLY

SEQ ID NO: 795505 - protein, 114 aa, Homo sapiens
MALPKDAIPSLSECQCGICMEILVEPVTLPCNHTLCKPCFQSTVEKASLCCPFCRRRVSSWTRYHTRRNSLVNVELWTIIQKHYPRECKLRASGQESEEVGEIWTQRQTRTEGR

SEQ ID NO: 795506 - protein, 301 aa, Homo sapiens
MARHGLPLLPLLSLLVGAWLKLGNGQATSMVQLQGGRFLMGTNSPDSRDGEGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 795507 - protein, 339 aa, Homo sapiens
MARHGLPLLPLLSLLVGAWLKLGNGQATSMVQLQGGRFLMGTNSPDSRDGEGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGWATLQIQPQTTSVSAVLQTQAGRQGSCKQPGGDKEKSLLGSLSFPGHVANSAIPSSRASASGKNFPFPVSHPSVAGASHQGRRGLSLLCFGEGAQCVLTMAGGQVFLLEAKYY

SEQ ID NO: 795508 - protein, 260 aa, Homo sapiens
PWVYAAQRGSPDGPAWVTAAAPAVAPGRRVAQARDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 795509 - protein, 162 aa, Homo sapiens
GRGCTRRSAAVLMARHGLPLLPLLSLLVGAWLKLGNGQATSMVQLQGGRFLMGTNSPDSRDGEGPVREATVKPFAIDIFPVTNKDFRDFVREKKYRTEAEMFGWSFVFEDFVSDELRNKATQPMKVKFTHGGTGSSQTAPTCGRESSPRETKLRMASMESPQ

SEQ ID NO: 795510 - protein, 160 aa, Homo sapiens
GRGCTRRSAAVLMARHGLPLLPLLSLLVGAWLKLGNGQATSMVQLQGGRFLMGTNSPDSRDGEGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVS

SEQ ID NO: 795511 - protein, 183 aa, Homo sapiens
GRGCTRRSAAVLMARHGLPLLPLLSLLVGAWLKLGNGQATSMVQLQGGRFLMGTNSPDSRDGEGPVREATVKPFAIDIFPVTNKDFRDFVREKKYRTEAEMFGWSFVFEDFVSDELRNKATQPMKVREPGLAAEGIGVGPGQGILWDMGYLGHSGESDLRGGGRGEARETHHGASDQYTLPGS

SEQ ID NO: 795512 - protein, 86 aa, Homo sapiens
HWPLLCLRGKTTESGSLPPEGLKGQVYPWGNWFQPNRTNLWQGKFPKGDKAEDGFHGVSPVNAFPAQNNYDGLLMHSWGNSVGEWH

SEQ ID NO: 795513 - protein, 301 aa, Homo sapiens; identical to SEQ ID NO: 795506

SEQ ID NO: 795514 - protein, 238 aa, Homo sapiens
MARHGLPLLPLLSLLVGAWLKLGNGQATSMVQLQGGRFLMGTNSPDSRDGEGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYVACSHTVTGCHGA

SEQ ID NO: 795515 - protein, 286 aa, Homo sapiens [sequence omitted]

SEQ ID NO: 795516 - protein, 238 aa, Homo sapiens
RSPIQSTNKDLRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 795517 - protein, 220 aa, Homo sapiens
SRSDGCIAISSVEDLADCRMERDENKASQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 795518 - protein, 177 aa, Homo sapiens
GRGCTRRSAAVLMARHGLPLLPLLSLLVGAWLKLGNGQATSMVQLQGGRFLMGTNSPDSRDGEGPVREATVKPFAIDIFPVTNKDFRDFVREKKYRTEAEMFGWSFVFEDFVSDELRNKATQPMKSVLWWLPVEKAFWRQVKFTHGGTGSSQTAPTCGRESSPRETKLRMASMESPQ

SEQ ID NO: 795519 - protein, 171 aa, Homo sapiens
MLSPPRTTTGSMTSWGTCGSGQHHRTRLLSRTCASSGGHPGSTQLMALPITGPGSPPGWATLQIQPQTTSVSAVLQTQAGRQGSCKQPGGDKEKSLLGSLSFPGHVANSAIPSSRASASGKNFPFPVSHPSVAGASHQGRRGLSLLCFGEGAQCVLTMAGGQVFLLEAKYY

SEQ ID NO: 795520 - protein, 114 aa, Homo sapiens
GRGCTRRSAAVLMARHGLPLLPLLSLLVGAWLKLGNGQATSMVQLQGGRFLMGTNSPDSRDGEGPVREATVKPFAIDIFPVTNKDFRSSLPMGELVPAKPHQPVAGKVPQGRQS

SEQ ID NO: 795521 - protein, 171 aa, Homo sapiens; identical to SEQ ID NO: 795519

SEQ ID NO: 795522 - protein, 63 aa, Homo sapiens
MRSRKPVSLNPGCQPAGPGSGIRERLEHPVLHVSWNDARAYCAWRGKRLPTEEEWEFAARGGL

SEQ ID NO: 795523 - protein, 80 aa, Homo sapiens
GQSSASLRQFPPAELLGAGRVVAQPAHVHRGRLPLRCMRAHAQRGRGCTRRSAAVLMARHGLPLLPLLSLLVGAWLKLGQ

SEQ ID NO: 795524 - protein, 108 aa, Homo sapiens
SPAEPAELCLYRDFVREKKYRTEAEMFGWSFVFEDFVSDELRNKATQPMKVREPGLAAEGIGVGPGQGILWDMGYLGHSGESDLRGGGRGEARETHHGASDQYTLPGS

SEQ ID NO: 795525 - protein, 95 aa, Homo sapiens
LACKFAELKEKIDRRSGKKLEDGPKFLKSGDAAIVDMVPGKPMCVESFSDYPPLGRFAVRDMRQTVAVGVIKAVDKKAAGAGKVTKSAQKAQKAK

SEQ ID NO: 795526 - protein, 692 aa, Homo sapiens
DCEMCQNFFIDSCAAHGPPTFVKDSAVDKGHPNRSALSLPPGLRIGPSGIPQAGLGVWNEASDLPLGLHFGPYEGRITEDEEAANNGYSWLVRRACHFTKGRNCYEYVDGKDKSWANWMRYVNCARDDEEQNLVAFQYHRQIFYRTCRVIRPGCELLVWYGDEYGQELGIKWGSKWKKEEPKPEIHPCPSCCLAFSSQKFLSQHVERNHSSQNFPGPSARKLLQPENPCPGDQNQEQQYPDPHSRNDKTKGQEIKERSKLLNKRTWQREISRAFSSPPKGQMGSCRVGKRIMEEESRTGQKVNPGNTGKLFVGVGISRIAKVKYGECGQGFSVKSDVITHQRTHTGEKLYVCRECGRGFSWKSHLLIHQRIHTGEKPYVCRECGRGFSWQSVLLTHQRTHTGEKPYVCRECGRGFSRQSVLLTHQRRHTGEKPYVCRECGRGFSRQSVLLTHQRRHTGEKPYVCRECGRGFSWQSVLLTHQRTHTGEKPYVCRECGRGFSWQSVLLTHQRTHTGEKPYVCRECGRGFSNKSHLLRHQRTHTGEKPYVCRECGRGFRDKSHLLRHQRTHTGEKPYVCRECGRGFRDKSNLLSHQRTHTGEKPYVCRECGRGFSNKSHLLRHQRTHTGEKPYVCRECGRGFRNKSHLLRHQRTHTGEKPYVCRECGRGFSDRSSLCYHQRTHTGEKPYVCREDE

SEQ ID NO: 795527 - protein, 90 aa, Homo sapiens
SRGRLRENGGVGRPRLLLGPGKPPINEWSGQRREGRGFSEDRALHLRSRVNGCREGKGCPYPSGPTSEPSPVVATLSRETGEARPGARPF

SEQ ID NO: 795528 - protein, 68 aa, Homo sapiens
FLGTVAHMQPRTQPLAQTLPFFLGGAPRDTGLRVPVIKMGTGWEGFQRTLKEVAYILLCCWCIKELLD

SEQ ID NO: 795529 - protein, 92 aa, Homo sapiens
LSFFLISILYPSLTISSKLENKGQVMKTEVKNDHVLFYLENGFGRADSFPFSVEQSNLVFNIQPAPAMVYDYYEKEEYALAFYNIDSSSVSE

SEQ ID NO: 795530 - protein, 101 aa, Homo sapiens
AEPPQETRRLGGVEGSELSGSQERKLPSWALPLAPSTQERQLGPPGPRIPKGAAPRGCVAGTGERTSQYRGWPSDQVGVGGSRAFGRRSGAHRRWDSADAC

SEQ ID NO: 795531 - protein, 101 aa, Homo sapiens; identical to SEQ ID NO: 795530

SEQ ID NO: 795532 - protein, 112 aa, Homo sapiens
MREGDGRTRDWGIGTKVLGTCRALCPYMISVQLSTLETQERSRGCREKQRLETEVWEPLSGTPSPSGKSGTRRSLSESDHCLISPGSGRLQTTCFLSDPGLRSDPCRIENPK

SEQ ID NO: 795533 - protein, 112 aa, Homo sapiens; identical to SEQ ID NO: 795532

SEQ ID NO: 795534 - protein, 143 aa, Homo sapiens
SPSLHLQPGSLVPTAPTPEMSRQCHALQEDMQTRSKQLEEEVKGLRGQLEACQREAAAAREEAEQALGERDQALAQLRAHMADMEAKYEEILHDSLDRLLAKLRAIKQQWDGAALRLHARHKEQQRQFGLTPPGSLRPPAPSL

SEQ ID NO: 795535 - protein, 106 aa, Homo sapiens
SPSCSLSSCLPPEACQREAAAAREEAEQALGERDQALAQLRAHMADMEAKYEEILHDSLDRLLAKLRAIKQQWDGAALRLHARHKEQQRQFGLTPPGSLRPPAPSL

SEQ ID NO: 795536 - protein, 88 aa, Homo sapiens
CRPQCGKNLFLFACVFSIDHQYVGSAGLVSAGSMESSRYLFTMSLNVFLESAPLKCIFLINLKCSQMQFPKAVYILPFCPKCFLRYSS

SEQ ID NO: 795537 - protein, 174 aa, Homo sapiens
NGLGEWAYSAPDLLGAWSWGSCAVYDSGGYVKELGLSLEESRDRLRFLQLHTGWQQEPRCVPGAPRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWT

SEQ ID NO: 795538 - protein, 97 aa, Homo sapiens
VPGSCPTFEKNELCSQPEGDQGREEFYQMAEELSTERVPKPLPCFELPYGESQWRGIEDRLLYGPEVIIPTTHEELNPDNNFIGKLGSGFSPKQALR

SEQ ID NO: 795539 - protein, 141 aa, Homo sapiens
ALCLKPEIVNGRLSVDKDQYVESENVTIECDSGYGVVGLKSITCSEKRTWYPEVPRCEWEAPEGCEQVLTGRKLMQCLPSPEDVKVALEVYKLSLEIKQLEKERDKLMNTHQKFSEKEEMKDLFFPSNQHTESSLIHPTLP

SEQ ID NO: 795540 - protein, 871 aa, Homo sapiens
MIKKFDKKDEESGSGSNPFQHLEKSAVLQEARIFNETPINPRRCLHILTKILYLLNQGEHFGTTEATEAFFAMTRLFQSNDQTLRRMCYLTIKEMATISEDVIIVTSSLTKDMTGKEDVYRGPAIRALCRITDGTMLQAIERYMKQAIVDKVSSVSSSALVSSLHMMKISYDVVKRWINEAQEAASSDNIMVQYHALGVLYHLRKNDRLAVSKMLNKFTKSGLKSQFAYCMLIRIASRLLKETEDGHESPLFDFIESCLRNKHEMVIYEAASAIIHLPNCTARELAPAVSVLQLFCSSPKPALRYAAVRTLNKVAMKHPSAVTACNLDLENLITDSNRSIATLAITTLLKTGSESSVDRLMKQISSFVSEISDEFKVVVVQAISALCQKYPRKHSVMMTFLSNMLRDDGGFEYKRAIVDCIISIVEENPESKEAGLAHLCEFIEDCEHTVLATKILHLLGKEGPRTPVPSKYIRFIFNRVVLENEAVRAAAVSALAKFGAQNESLLPSILVLLQRCMMDTDDEVRDRATFYLNVLQQRQMALNATYIFNGLTVSVPGMEKALHQYTLEPSEKPFDMKSIPLAMAPVFEQKAEITLVATKPEKLAPSRQDIFQEQLAAIPEFLNIGPLFKSSEPVQLTEAETEYFVRCIKHMFTNHIVFQFDCTNTLNDQLLEKVTVQMEPSDSYEVLSCIPAPSLPYNQPGICYTLVRLPDDDPTAVAGSFSCTMKFTVRDCDPNTGVPDEDGYDDEYVLEDLEVTVSDHIQKVLKPNFAAAWEEVGDTFEKEETFALSSTKTLEEAVNNIITFLGMQPCERSDKVPENKNSHSLYLAGIFRGGYDLLVRSRLALADGVTMQVTVRSKERTPVDVILASVG

SEQ ID NO: 795541 - protein, 871 aa, Homo sapiens; identical to SEQ ID NO: 795540

SEQ ID NO: 795542 - protein, 140 aa, Homo sapiens
AGSPAAAPGTVAVGLGAGKSSKMIKKFDKKDEESGSGSNPFQHLEKSAVLQEARIFNETPINPRRCLHILTKILYLLNQGEHFGTTEATEAFFAMTRLFQSNDQTLRRMCYLTIKEMATISEGLVVIGHRQDFWNVPSYV

SEQ ID NO: 795543 - protein, 263 aa, Homo sapiens
AQGGPVSICYICGAELGPGKEFQLNVNPASRLGEKEPFFPFLTVYPPAPRARPVDSTGLVATCVLCYHDLLAQWLQHEARSSHHAVSAWSRQYQVETFVCFFCQQEKKRCLGLKSVRVARLPLFLYTLRASHSLLVDDGQQLIIGACVECGTLVCAGQGLTRQGPMSWSSPVAAATKMNRRCFHYDAAPPSLAASLSWHLFYLNYSHLDTEVSEVRRGKVTCPRPHRCQLQGQSAPFSAQLHTGFLYSNSRFGAMGLRDAPSQ

SEQ ID NO: 795544 - protein, 73 aa, Homo sapiens
RTWGRASWWRLQRADIVPLHPANFCVLLVETGFHHVGQAGLELLTSGDPPTSASQSTGITGISHHAWPFILII

SEQ ID NO: 795545 - protein, 74 aa, Homo sapiens
PFDFTENGNAVMKPSAWPSPSLHVCLGGALPSQEPGHAGLQPPRPPPPFWTFIEACTLIRKRICHLPVRLRATT

SEQ ID NO: 795546 - protein, 74 aa, Homo sapiens; identical to SEQ ID NO: 795545

SEQ ID NO: 795547 - protein, 110 aa, Homo sapiens
RSQWLGSLTNVHLSPRVLSQSPGPGTLPCPRCLAQLAQRAHRRWAGKVGKAVWIDLVFPTFDQHTQLGCSRSMVGGGRWEPRFLEMWDWGFTRNHLLKSKKVIIIPSDFR

SEQ ID NO: 795548 - protein, 83 aa, Homo sapiens
LLLLFSTAYDTSRVPSEQLLPLYMKACWGQGKSSIRHDTPKLSCSHLNRTAFNGNHVNASHGMRDKIINLMLRKDVFRVFLEN

SEQ ID NO: 795549 - protein, 848 aa, Homo sapiens
MDEGTGLQPGAGEQLEAPATAEAVQERCEPETLRSKSLPVLSSASCRPSLSPTSGDANPAFGCVDSSGHQELKQGPNPLAPSPSAPSTSAGLGDCNHRVDLSKTFSVSSALAMLQERRCLYVVLTDSRCFLVCMCFLTFIQALMVSGYLSSVITTIERRYSLKSSESGLLVSCFDIGNLVVVVFVSYFGGRGRRPLWLAVGGLLIAFGAALFALPHFISPPYQIQELNASAPNDGLCQGGNSTATLEPPACPKDSGGNNHWVYVALFICAQILIGMGSTPIYTLGPTYLDDNVKKENSSLYLAIMYVMGALGPAVGYLLGGLLIGFYVDPRNPVHLDQNDPRFIGNWWSGFLLCAIAMFLVIFPMFTFPKKLPPRHKKKKKKKFSVDAVSDDDVLKEKSNNSEQADKKVSSMGFGKDVRDLPRAAVRILSNMTFLFVSLSYTAESAIVTAFITFIPKFIESQFGIPASNASIYTGVIIVPSAGVGIVLGGYIIKKLKLGARESAKLAMICSGVSLLCFSTLFIVGCESINLGGINIPYTTGPSLTMPHRNLTGSCNVNCGCKIHEYEPVCGSDGITYFNPCLAGCVNSGNLSTGIRNYTECTCVQSRQVITPPTVGQRSQLRVVIVKTYLNENGYAVSGKCKRTCNTLIPFLVFLFIVTFITACAQPSAIIVTLRSVEDEERPFALGMQFVLLRTLAYIPTPIYFGAVIDTTCMLWQQECGVQGSCWEYNVTSFRFVYFGLAAGLKFVGFIFIFLAWYSIKYKEDGLQRRRQREFPLSTVSERVGHPDNARTRSCPAFSTQGEFHEETGLQKGIQCAAQTYPGPFPEAISSSADPGLEESPAALEPPS

SEQ ID NO: 795550 - protein, 137 aa, Homo sapiens
GGLLIAFGAALFALPHFISPPYQIQELNASAPNDGLCQGGNSTATLEPPACPKDSGGNNHWVYVALFICAQILIGMGSTPIYTLGPTYLDDNVKKENSSLYLGKTFLFSQICFTHTETYFPYKNQKETCSFTFSCIL

SEQ ID NO: 795551 - protein, 826 aa, Homo sapiens
MDEGTGLQPGAGEQLEAPATAEAVQERCEPETLRSKSLPVLSSASCRPSLSPTSGDANPAFGCVDSSGHQELKQGPNPLAPSPSAPSTSAGLGDCNHRVDLSKTFSVSSALAMLQERRCLYVVLTDSRCFLVCMCFLTFIQALMVSGYLSSVITTIERRYSLKSSESGLLVSCFDIGNLVVVVFVSYFGGRGRRPLWLAVGGLLIAFGAALFALPHFISPPYQIQELNASAPNDGLCQGGNSTATLEPPACPKDSGGNNHWVYVALFICAQILIGMGSTPIYTLGPTYLDDNVKKENSSLYLAIMYVMGALGPAVGYLLGGLLIGFYVDPRNPVHLDQNDPRFIGNWWSGFLLCAIAMFLVIFPMFTFPKKLPPRHKKKKKKKFSVDAVSDDDVLKEKSNNSEQADKKVSSMGFGKDVRDLPRAAVRILSNMTFLFVSLSYTAESAIVTAFITFIPKFIESQFGIPASNASIYTGVIIVPSAGVGIVLGGYIIKKLKLGARESAKLAMICSGVSLLCFSTLFIVGCESINLGGINIPYTTGPSLTMPHRNLTGSCNVNCGCKIHEYEPVCGSDGITYFNPCLAGCVNSGNLSTGIRNYTECTCVQSRQVITPPTVGQRSQLRVVIVKTYLNENGYAVSGKCKRTCNTLIPFLVFLFIVTFITACAQPSAIIVTLSIHSYSNLFGAVIDTTCMLWQQECGVQGSCWEYNVTSFRFVYFGLAAGLKFVGFIFIFLAWYSIKYKEDGLQRRRQREFPLSTVSERVGHPDNARTRSCPAFSTQGEFHEETGLQKGIQCAAQTYPGPFPEAISSSADPGLEESPAALEPPS

SEQ ID NO: 795552 - protein, 126 aa, Homo sapiens [sequence omitted]

SEQ ID NO: 795553 - protein, 111 aa, Homo sapiens [sequence omitted]

SEQ ID NO: 795554 - protein, 136 aa, Homo sapiens
NPLRVRPPIPVWLFGGWALCSSLVKPCVLWAAIQKLDGQLRRWEGKGHAAGHPPARRREYLRNKVCENWLCSVLKLGNGLSTWGMCLKCRLKCPFLHSNFSRYESAFLLLTSLPSDSEAGAVLYLDYHRVRLSGYL

SEQ ID NO: 795555 - protein, 106 aa, Homo sapiens
NPLRVRPPIPVWLFGGWALCSSLVKPCVLWAAIQKLDGQLRRWEGKGHAAGHPPARRREYLRNKVCENWLCSVLKLGNGLSTWGMCLKCRLKCPFLHSNFSSAVSC

SEQ ID NO: 795556 - protein, 106 aa, Homo sapiens
MGQLLGVSLLPSQPRPPWPLCLSPALVTDLHAHTRGHLTLLSHQDPPLGSPSPALTHLSGFNRATSADPLSPPSPHPSHCCCLHPPQGWVGISFYRVTGALLTKIS

SEQ ID NO: 795557 - protein, 70 aa, Homo sapiens
RVSLVGELSKFPLPSDSSGGKSSSSFARGALAWCRQRNPNPSCAAAETGARTSLPKERCRGWRLGNWLHK

SEQ ID NO: 795558 - protein, 116 aa, Homo sapiens
MGGRDQITNLGSEGETHPWGYSSPPYPLHTFFIPFLPSGFGGSGLGIPSDNEKHDLQDCVEVSRPEGPAPELPSSLCGWNKISSLCGLGFPSRDPKTWDLAMLLSPWVDFFELQLL

SEQ ID NO: 795559 - protein, 95 aa, Homo sapiens
MCKTCVSRVQVAAIHAAQGWEAARVHQDACDITPAGGQVTGGDPGIGAVARNIRPESHSPAAAEKPPHQRPQLVQIPWHCFQPSELRLFQGRGPA

SEQ ID NO: 795560 - protein, 30 aa, Homo sapiens
MQANILGACKGTKPCILAPPATPAESCQPG

SEQ ID NO: 795561 - protein, 32 aa, Homo sapiens
MLGHAHQVQVTPFAPLTFRAPLGALSRHVLTV

SEQ ID NO: 795562 - protein, 82 aa, Homo sapiens
LKVLSQNTLELGLCRKHAQTGGQFSDSRNRDCRGLQALKLVWFWESEFRSEEGDFETSLPSARGCLWEEVGFMKGIWLTQRM

SEQ ID NO: 795563 - protein, 77 aa, Homo sapiens
RRLGSSNPPISTSQAARTIGTCHHTQQQRQLTMSTMPLAQEPANERTLQWWFREFCKGEESLEDEEHSGRPLEVDND

SEQ ID NO: 795564 - protein, 129 aa, Homo sapiens [sequence omitted]

SEQ ID NO: 795565 - protein, 161 aa, Homo sapiens
MTPPLFSPRLSPASVGTGEKAHQAGLCHLRVGHQGQPAAGAGGTGPEPPAEVEAAAGGFAEQEGDDSAGRAAHPRGPGELPVQGMPLERLRNKIIQATFSISGTKSLANEISDNDILEALQRIISERSDYYNQLKQKGVKVPPLQQSEAFLTSKSKKGTSK

SEQ ID NO: 795566 - protein, 522 aa, Homo sapiens
MSITSDEVNFLVYRYLQESGFSHSAFTFGIESHISQSNINGTLVPPSALISILQKGLQYVEAEISINKDGTVFDSRPIESLSLIVAVIPDVVQMRQQAFGEKLTQQQASAAATEASAMAKAATMTPAAISQQNPPKNREATVNGEENGAHEINNHSKPMEIDGDVEIPPNKATVLRGHESEVFICAWNPVSDLLASGSGDSTARIWNLNENSNGGSTQLVLRHCIREGGHDVPSNKDVTSLDWNSDGTLLAMGSYDGFARIWTENGNLASTLGQHKGPIFALKWNKKGNYVLSAGVDKTTIIWDAHTGEAKQQFPFHSAPALDVDWQNNMTFASCSTDMCIHVCRLGCDHPVKTFQGHTNEVNAIKWDPSGMLLASCSDDMTLKIWSMKQDACVHDLQAHSKEIYTIKWSPTGPATSNPNSSIMLASASFDSTVRLWDVEQGVCTHTLMKHQEPVYSVAFSPDGKYLASGSFDKYVHIWNTQSGSLVHSYQGTGGIFEVCWNARGDKVGASASDGSVCVLDL

SEQ ID NO: 795567 - protein, 522 aa, Homo sapiens; identical to SEQ ID NO: 795566

SEQ ID NO: 795568 - protein, 522 aa, Homo sapiens; identical to SEQ ID NO: 795566

SEQ ID NO: 795569 - protein, 478 aa, Homo sapiens
RLVEPGIISAEAAKMAASCLVLLALCLLLPLLLLGGWKRWRRGRAARHVVAVVLGDVGRSPRMQYHALSLAMHGFSVTLLGFCNSKPHDELLQNNRIQIVGLTELQSLAVGPRVFQYGVKVVLQAMYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPALLVSSTSWTEDEDFSILLAALEKFEQLTLDGHNLPSLVCVITGKGPLREYYSRLIHQKHFQHIQVCTPWLEAEDYPLLLGSADLGVCLHTSSSGLDLPMKVVDMFGCCLPVCAVNFKCLHELVKHEENGLVFEDSEELAAQLQMLFSNFPDPAGKLNQFRKNLRESQQLRWDESWVQTVLPLVMDT

SEQ ID NO: 795570 - protein, 478 aa, Homo sapiens; identical to SEQ ID NO: 795569

SEQ ID NO: 795571 - protein, 409 aa, Homo sapiens
RLVEPGIISAEAAKMAASCLVLLALCLLLPLLLLGGWKRWRRGRAARHVVAVVLGDVGRSPRMQYHALSLAMHGFSVTLLGFCNSKPHDELLQNNRIQIVGLTELQSLAVGPRVFQYGVKVVLQAMYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPALLVSSTSWTEDEDFSILLAALEKFEQLTLDGHNLPSLVCVITGKGPLREYYSRLIHQKHFQHIQVCTPWLEAEDYPLLLGSADLGVCLHTSSSGLDLPMKVVDMFGCCLPVCAVNFK

SEQ ID NO: 795572 - protein, 285 aa, Homo sapiens
MATPSWVWCMAPTIPSFCWPSEDLADNWHIRAVTVYDKPASFFKETPLDLQHRLFMKLGSMHSPFRARSEPEDPVTERSAFTERDAGSGLVTRLRERPALLVSSTSWTEDEDFSILLAALEKFEQLTLDGHNLPSLVCVITGKGPLREYYSRLIHQKHFQHIQVCTPWLEAEDYPLLLGSADLGVCLHTSSSGLDLPMKVVDMFGCCLPVCAVNFKCLHELVKHEENGLVFEDSEELAAQLQMLFSNFPDPAGKLNQFRKNLRESQQLRWDESWVQTVLPLVMDT

SEQ ID NO: 795573 - protein, 351 aa, Homo sapiens
RLVEPGIISAEAAKMAASCLVLLALCLLLPLLLLGGWKRWRRGRAARHVVAVVLGDVGRSPRMQYHALSLAMHGFSVTLLGFCNSKPHDELLQNNRIQIVGLTELQSLAVGPRVFQYGVKVVLQAMYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPALLVSSTSWTEDEDFSILLAALETLVGLDFFSGGLETLPLFFCSSRPMPLLAYYCSVTSL

SEQ ID NO: 795574 - protein, 136 aa, Homo sapiens
ATDNRTSSSSSLCASSSVLPRLCCPSTEEAEDYPLLLGSADLGVCLHTSSSGLDLPMKVVDMFGCCLPVCAVNFKCLHELVKHEENGLVFEDSEELAAQLQMLFSNFPDPAGKLNQASSWSLRANPFEQHLPVARS

SEQ ID NO: 795575 - protein, 431 aa, Homo sapiens
RLPVVKLESLKRWNEERGLWCEKGVQVLLTTVGAFAAFGLMTIAISTDYWLYTRALICNTTNLTAGGDDGTPHRGGGGASEKKDPGGLTHSGLWRICCLEGLKRGVCVKINHFPEDTDYDHDSAEYLLRVVRASSIFPILSAILLLLGGVCVAASRVYKSKRNIILGAGILFVAAGLSNIIGVIVYISANAGEPGPKRDEEKKNHYSYGWSFYFGGLSFILAEVIGVLAVNIYIERSREAHCQSRSDLLKAGGGAGGSGGSGPSAILRLPSYRFRYRRRSRSSSRSSEPSPSRDASPGGPGGPGFASTDISMYTLSRDPSKGSVAAGLAGAGGGGGGAVGAFGGAAGGAGGGGGGGGGAGAERDRGGASGFLTLHNAFPKEAGGGVTVTVTGPPAPPAPAPPAPSAPAPGTLAKEAAASNTNTLNRKTTPV

SEQ ID NO: 795576 - protein, 104 aa, Homo sapiens
MGVSCRRPGTVRLRFPVLPQDSHFAKAPGRGAEVSHQHCGKHTDTFANELVSLWSFHQGGRGKFGFSYCFRRVLYRVGLNEVKGALCRIPRHWIPWLAPALLSS

SEQ ID NO: 795577 - protein, 82 aa, Homo sapiens
MLTKPWSLARCITSVQGENPHMAQAVASELKIFHWPLCISLKFTSHDTSHVGLRRASNCYSFASSGLELKQAKKARIWNSTS

SEQ ID NO: 795578 - protein, 144 aa, Homo sapiens
MEGFDLCPSVLAHFSLCEAPPQSSRASQSAVRGILAGQFVLCGVFALHCSACLPTVCCCLCSPVRRIAFLQILAPRPHFPKCHPPAISFGSRRPRDGFTDDDILFGPALASFSHMWSAWSGCSRCGPHFSCRQKQQPGVPCLVS

SEQ ID NO: 795579 - protein, 71 aa, Homo sapiens
TGGIAGEQQCLRMTGAVQSISCDLRMCQSCPGTTRGRPSAPFTSSLPPHPQQHWLLGVCMAEEGLDTGYPG

SEQ ID NO: 795580 - protein, 346 aa, Homo sapiens
PGFRPVCRQRCGPAHVMAPEENAGTELLLQSFERRFLAARTLRSFPWQSLEAKLRDSSDSELLRDILHKTVKHPVCVKHPPSVKYARCFLSELIKKHEAVHTEPLDELYEALAETLMAKESTQGHRSYLLPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 795581 - protein, 346 aa, Homo sapiens; identical to SEQ ID NO: 795580

SEQ ID NO: 795582 - protein, 346 aa, Homo sapiens; identical to SEQ ID NO: 795580

SEQ ID NO: 795583 - protein, 467 aa, Homo sapiens
PGFRPVCRQRCGPAHVMAPEENAGTELLLQSFERRFLAARTLRSFPWQVGGGASGEARGARGSPGADGRVSVLKPLALPPREFLGSRRSGPRDPVPVPGAWPESLAPLLPRELAGEAGGVSTALGGRRALGVGYSSRSFSRLFKGSNRSGHWDTAALAHSKKSAPSGPQSLEAKLRDSSDSELLRDILHKTVKHPVCVKHPPSVKYARCFLSELIKKHEAVHTEPLDELYEALAETLMAKESTQGHRSYLLPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 795584 - protein, 346 aa, Homo sapiens; identical to SEQ ID NO: 795580

SEQ ID NO: 795585 - protein, 279 aa, Homo sapiens
AVGRRLDSSPRRREENAGTELLLQSFERRFLAARTLRSFPWQSLEAKLRDSSDSELLRDILHKPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 795586 - protein, 141 aa, Homo sapiens
PSDRWTDSLAFSWCSPREARSHSPRARPSSPTVPQAWSHGTPPSTLQNGPSRTRQSSLTGDLGAQGRAPRQAYLPFQSLPHGSVPEPCPVSFRDHRRKTTTSGTKTGPLREGGVWLGHRKPLTPASTLSPLSGGTELCLWS

SEQ ID NO: 795587 - protein, 104 aa, Homo sapiens
LLNGLSLEADITAKLDSPRVTVAQLDWDVATVHQLSAFQPDVVIAAGNAQPRAPCAGGVLAALPSSWLWEKGTMDAVGHGHDGASRRVTLGLQGDITGQGCLLR

SEQ ID NO: 795588 - protein, 334 aa, Homo sapiens
PGFRPVCRQRCGPAHVMAPEENAGTELLLQSFERRFLAARTLRSFPWQSLEAKLRDSSDSELLRDILHKTVKHPVCVKHPPSVKYARCFLSELIKKHEAVHTEPLDELYEALAETLMAKESTQGHRSYLLPSGGSVTLSESTAIISYGTTGLVTWDAALYLAEWAIENPAVFTNSDLGAQGRAPRQAYPGAVADTVPFPPARTVLELGSGAGLTGLAICKMCRPRAYIFSDCHSRVLEQLRGNVLLNGLSLEADITAKLDSPRVTVAQLDWDVATVHQLSAFQPDVVIAADVLELAQKAIMFAGAGNRGEEESLAGGTKGTLKDNAGIYGRNPK

SEQ ID NO: 795589 - protein, 365 aa, Homo sapiens
GCRSPFGFVTQASRGERGDRTLAAEFRAPLPGGTHTALLPLAGSNRSGHWDTAALAHSKKSAPSGPQSLEAKLRDSSDSELLRDILHKTVKHPVCVKHPPSVKYARCFLSELIKKHEAVHTEPLDELYEALAETLMAKESTQGHRSYLLPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 795590 - protein, 312 aa, Homo sapiens
PGFRPVCRQRCGPAHVMAPEENAGTELLLQSFERRFLAARTLRSFPWQSLEAKLRDSSDSELLRDILHKTVKHPVCVKHPPSVKYARCFLSELIKKPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 795591 - protein, 331 aa, Homo sapiens
GCRSPFGFVTQASRGERGDRTLAAEFRAPLPGGTHTALLPLAGSNRSGHWDTAALAHSKKSAPSGPQSLEAKLRDSSDSELLRDILHKTVKHPVCVKHPPSVKYARCFLSELIKKPSGGSVTLSESTAIISYGTTGLVTWDAALYLAEWAIENPAVFTNRTVLELGSGAGLTGLAICKMCRPRAYIFSDCHSRVLEQLRGNVLLNGLSLEADITAKLDSPRVTVAQLDWDVATVHQLSAFQPDVVIAADVLYCPEAIMSLVGVLRRLAACREHQRAPEVYVAFTVRNPETCQLFTTELGRAGIRWEVEPRHEQKLFPYEEHLEMAMLNLTL

SEQ ID NO: 795592 - protein, 284 aa, Homo sapiens
MSVAVWIRHPGVARRTRGPNSCCRVSSAASWRHAHCAPSPGRWAAGRAERPAGLAGVQGQTGRVSVLKPLALPPREFLGSRRSGPRDPVPVPGAWPESLAPLLPRELAGEAGGVSTALGGRRALGVGYSSRSFSRLFKGSNRSGHWDTAALAHSKKSAPSGPQSLEAKLRDSSDSELLRDILHKTVKHPVCVKHPPSVKYARCFLSELIKKPSGGSVTLSESTAIISYGTTGLVTWDAALYLAEWAIENPAVFTNRCAVLPRSHHVAGRRPAEAGCLPGAPAGS

SEQ ID NO: 795593 - protein, 121 aa, Homo sapiens
MGLTVLSSPGLKMSMLGRPPTPPQLTQVPTSGCVDLQKGPLLSPVRHPRGHTGPQILPQAWEPTGRRVRQCRGPQTFPKRPESKYFRLCGPQVLCCKTQFCYCSSKAAVDNSEGNECVVSQ

SEQ ID NO: 795594 - protein, 112 aa, Homo sapiens [sequence omitted]

SEQ ID NO: 795595 - protein, 66 aa, Homo sapiens
EGKELSTFHRIFSRKTNSIKLALANSQDANPHALRSENAIIRVAFHEIFLLQNSHFLPKMSLFPKT

SEQ ID NO: 795596 - protein, 226 aa, Homo sapiens
RRRKHGSGPSRGAGTRLPAERLQLGDLPHGRSPAGQGNRRGGGLLVRPSPPNSGPLAAPGDHRVRPSPGRAQSWTPPPSVTACIFSPFPSQPAERRQPQSRCLHPLLMPAVFMLASSSALQCGRGVPRFPRTEVGAGHSVNEETKAEKVGNQTSVIPATSRQAALGTSWTQRRTQPLQERSHWHPRGNNASGMGGHRMFPGPLRGPAAQVLENECGSLGRAAEGRS

SEQ ID NO: 795597 - protein, 226 aa, Homo sapiens; identical to SEQ ID NO: 795596

SEQ ID NO: 795598 - protein, 226 aa, Homo sapiens; identical to SEQ ID NO: 795596

SEQ ID NO: 795599 - protein, 101 aa, Homo sapiens
GPATESAFATETSGHAVVPRDHLHNVHVFIWGLARRPPSLPVAMEIAPVKENVICLKQQDTSYRRMTPDAPSRCCMLQAWAGCWVEHLQRKMEARVPVLDS

SEQ ID NO: 795600 - protein, 155 aa, Homo sapiens
SPLLPIPRMSTSALAQSSHLYQALPHLWSETSAGGFGFENKPGSLGGLFSVCLPGSLLNSSPPLPLSTERGGPCSSQLNLAWQRWSHGATGAEGRWKLLGGPDRGLQVAGWDQWFIQTFTVRLAGSQDPGRNPRLPSFTGVPHSWVPQSLQHSPP

SEQ ID NO: 795601 - protein, 179 aa, Homo sapiens
RRRPRSPSTRACAWVLAALPLAVPVPGGPFWPSSMVDYYEVLDVPRQASSEAIKKAYRKLALKWHPDKNPENKEEAERRFKQVAEAYEVLSDAKKRDIYDRYGEAGAEGGCTGGRPFEDPFEYVFSFRDPADVFREFFGGQDPFSFDLLGNPLENILGGSEELLGKQKQSVCTPFLCLQ

SEQ ID NO: 795602 - protein, 179 aa, Homo sapiens; identical to SEQ ID NO: 795601

SEQ ID NO: 795603 - protein, 112 aa, Homo sapiens
RRRPRSPSTRACAWVLAALPLAVPVPGGPFWPSSMVDYYEVLDVPRQASSEAIKKAYRKLALKWHPDKNPENKEEADFVPLAPWEVGAFLPSACPTVVMGQAASSPCRLPLK

SEQ ID NO: 795604 - protein, 112 aa, Homo sapiens; identical to SEQ ID NO: 795603

SEQ ID NO: 795605 - protein, 142 aa, Homo sapiens
RRRPRSPSTRACAWVLAALPLAVPVPGGPFWPSSMVDYYEVLDVPRQASSEAIKKAYRKLALKWHPDKNPENKEEAERRFKQVAEAYEVLSDAKKRDIYDRYGEAGAEGGCTGGRPFEDPFEISFLWLPGKWGPFFLLHVLR

SEQ ID NO: 795606 - protein, 411 aa, Homo sapiens
MADQIPLYPVRSAAAAAANRKRAAYYSAAGPRPGADRHSRNEHPAPLCMYPTMTARLGWMSPLLTWSALTPPGQWGECLPTAGACGSPGFTHSLLFKYQLEDESAHLDEMPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDMVFLRTSEKAGSCFIRTDQLDGETDWKLKVAVSCTQQLPALGDLFSISAYVYAQKPQMGIHSFEGTFTREDSDPPIHESLSIENTLWQHHCCISTVIGVTGSELD

SEQ ID NO: 795607 - protein, 354 aa, Homo sapiens
MADQIPLYPVRSAAAAAANRKRAAYYSAAGPRPGADRHSRYQLEDESAHLDEMPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDMVFLRTSEKAGSCFIRTDQLDGETDWKLKVAVSCTQQLPALGDLFSISAYVYAQKPQMGIHSFEGTFTREDSDPPIHESLSIENTLWQHHCCISTVIGVTGSELD

SEQ ID NO: 795608 - protein, 1938 aa, Homo sapiens
MSSDAEMAIFGEAAPYLRKPEKERIEAQNRPFDSKKACFVADNKEMYVKGMIQTRENDKVIVKTLDDRMLTLNNDQVFPMNPPKFDKIEDMAMMTHLHEPAVLYNLKERYAAWMIYTYSGLFCVTVNPYKWLPVYKPEVVAAYRGKKRQEAPPHIFSISDNAYQFMLTDRDNQSILITGESGAGKTVNTKRVIQYFATIAVTGDKKKETQPGKMQGTLEDQIIQANPLLEAFGNAKTVRNDNSSRFGKFIRIHFGATGKLASADIETYLLEKSRVTFQLSSERSYHIFYQIMSNKKPELIDLLLISTNPFDFPFVSQGEVTVASIDDSEELLATDNAIDILGFSSEEKVGIYKLTGAVMHYGNMKFKQKQREEQAEPDGTEVADKAGYLMGLNSAEMLKGLCCPRVKVGNEYVTKGQNVQQVTNSVGALAKAVYEKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYDQHLGKSNNFQKPKPAKGKAEAHFSLVHYAGTVDYNIAGWLDKNKDPLNETVVGLYQKSSLKLLSFLFSNYAGAETGDSGGSKKGGKKKGSSFQTVSAVFRENLNKLMTNLRSTHPHFVRCLIPNETKTPGVMDHYLVMHQLRCNGVLEGIRICRKGFPSRILYADFKQRYRILNASAIPEGQFIDSKNASEKLLNSIDVDREQFRFGNTKVFFKAGLLGLLEEMRDEKLVTLMTSTQAVCRGYLMRVEFKKMMERRDSIFCIQYNIRSFMNVKHWPWMNLFFKIKPLLKSAEAEKEMATMKEDFERTKEELARSEARRKELEEKMVSLLQEKNDLQLQVQSETENLMDAEERCEGLIKSKILLEAKVKELTERLEEEEEMNSELVAKKRNLEDKCSSLKRDIDDLELTLTKVEKEKHATENKVKNLSEEMTALEENISKLTKEKKSLQEAHQQTLDDLQVEEDKVNGLIKINAKLEQQTDDLEGSLEQEKKLRADLERAKRKLEGDLKMSQESIMDLENEKQQIEEKLKKKEFELSQLQARIDDEQVHSLQFQKKIKELQARIEELEEEIEAEHTLRAKIEKQRSDLARELEEISERLEEASGATSAQIEMNKKREAEFQKMRRDLEEATLQHEATAATLRKKQADSVAELGEQIDNLQRVKQKLEKEKSELKMEIDDMASNIEALSKSKSNIERTCRTVEDQFSEIKAKDEQQTQLIHDLNMQKARLQTQNGELSHRVEEKESLISQLTKSKQALTQQLEELKRQMEEETKAKNAMAHALQSSRHDCDLLREQYEEEQEAKAELQRALSKANSEVAQWKTKYETDAIQRTEELEEAKKKLAQRLQEAEEKTETANSKCASLEKTKQRLQGEVEDLMRDLERSHTACATLDKKQRNFDKVLAEWKQKLDESQAELEAAQKESRSLSTELFKMRNAYEEVVDQLETLRRENKNLQEEISDLTEQIAETGKNLQEAEKTKKLVEQEKSDLQVALEEVEGSLEHEESKILRVQLELSQVKSELDRKVIEKDEEIEQLKRNSQRAAEALQSVLDAEIRSRNDALRLKKKMEGDLNEMEIQLGHSNRQMAETQRHLRTVQGQLKDSQLHLDDALRSNEDLKEQLAIVERRNGLLLEELEEMKVALEQTERTRRLSEQELLDASDRVQLLHSQNTSLINTKKKLEADIAQCQAEVENSIQESRNAEEKAKKAITDAAMMAEELKKEQDTSAHLERMKKNLEQTVKDLQHRLDEAEQLALKGGKKQIQKLENRVRELENELDVEQKRGAEALKGAHKYERKVKEMTYQAEEDRKNILRLQDLVDKLQAKVKSYKRQAEEAEEQANTQLSRCRRVQHELEEAAERADIAESQVNKLRAKSRDVGSQKMEE

SEQ ID NO: 795609 - protein, 447 aa, Homo sapiens
FKVAAERRASEEEENKASEEYIQRLLAEEEEEEKRQAEKRRRAMEEQLKSDEELARKLSIDINNFCEGSISASPLNSRKSDPVTPKSEKKSKNKQRNTGDIQKYLTPKSQFGSASHSEAVQEVRKDSVSKDIDSSDRKSPTGQDTEIEDMPTLSPQISLGVGEQGADSSIESPMPWLCACGAEWYHEGNVKTRPSNHGKELCVLSHERPKTRVPYSKETAVMPCGRTESGCAPTSGVTQTNGNNTGETENEESCLLISKEISKRKNQESSFEAVKDPCFSAKRRKVSPESSPDQEETEINFTQKLIDLEHLLFERHKQEEQDRLLALQLQKEVDKEQMVPNRQKGSPDEYHLRATSSPPDKVLNGQRKNPKDGNFKRQTHTKHPTPERGSRDKNRQVSLKMQLKQSVNRRKMPNSTRDHCKVSKSAHSLQPSISQKSVFQMFQRCTK

SEQ ID NO: 795610 - protein, 131 aa, Homo sapiens
DCSGTISAHCKLHLLGSSDSPASASRVTGITGACHHAWLIFVFLVQMRFYHVGQAGLELLTSGDPPTLASQRAGITGVSHRVWPYTSLPKPALPFPYAIEALGRGGGGNGTGIHHLILVPSLTWLLFINAY

SEQ ID NO: 795611 - protein, 107 aa, Homo sapiens [sequence omitted]

SEQ ID NO: 795612 - protein, 157 aa, Homo sapiens
MNPQREAAPKSYAIRDSRQMVWVLSGNSLIAAPLSRSIKPVTLHLIACRDTEFSDKEKGNMVYLGIKGKDLCLFCAEIQGKPTLQLKEKNIMDLYVEKKAQKPFLFFHNKEGSTSVFQSVSYPGWFIATSTTSGQPIFLTKERGITNNTNFYLDSVE

SEQ ID NO: 795613 - protein, 164 aa, Homo sapiens
MNPQREAAPKSYAIRDSRQMVWVLSGNSLIAAPLSRSIKPVTLHLIACRDTEFSDKEKGNMVYLGIKGKDLCLFCAEIQGKPTLQLKLQGSQDNIGKDTCWKLVGIHTCINLDVRESCFMGTLDQWGIGVGRKKWKSSFQHHHLRKKDKDFSSMRTNIGMPGRM

SEQ ID NO: 795614 - protein, 119 aa, Homo sapiens
PHWSPCSYLNGPGIFLTDCLCLNQFLESSFFSYHCSYPPSRPLFIEAYFDYLKLQLPYSNCNLHFLNGTPDLLVLLHSFPLTVDNLIIFLGYCLSLYIECKFHRAGLKQCLAYTAKFLQ

SEQ ID NO: 795615 - protein, 109 aa, Homo sapiens
LELSSAGGHVLLVLPGALGCSLRKAQGEIRGPEKCHCLHPAKAHFFLLLLFLFFFSSCSLIAPSPPHSCSLLLHLQFLNNPDVFLISGPSVESVFKDEYFLLCYCYFFR

SEQ ID NO: 795616 - protein, 109 aa, Homo sapiens
TLQSLLPIFPQAFFPINPRINLPYATKALLSVFPIYALYFDCHPFLTLHSSLGDRARLRFNIYVYIIFVLLYVHDPFFTKIKNMFSESHKTKNAFASLKLGLTHHDKAV

SEQ ID NO: 795617 - protein, 94 aa, Homo sapiens
MLRHQKLLLFSVTLYLLTTALPPYRRNGQTSESYRFLPPVTSHDLLWVNCFLYIFVSPSKSHILLYLKDKYVLKHLKYSPFGGCSFSWKTKQLR

SEQ ID NO: 795618 - protein, 34 aa, Homo sapiens
RWARVSSYSRSQTWDSVLTGNPKHQSNKNQGNSS

SEQ ID NO: 795619 - protein, 89 aa, Homo sapiens
MDPNCSCAAGGSYACAGSCKCKKCKCTSCKKSCCSCCPLGCAKCAQGCIRKGASEKAAAVPDVGTALLSDENRMTRKVRDFFFYNPDPF

SEQ ID NO: 795620 - protein, 58 aa, Homo sapiens
MKTQDDGVLPPYDVNQLLGWDLNLSLFLGLCLMLLLAGSCLPSPGITGLSHGSNREDR

SEQ ID NO: 795621 - protein, 158 aa, Homo sapiens
MEKALKIDTPQQGSIQDINHRVWVLQDQTLIAVPRKDRMSPVTIALISCRHVETLEKDRGNPIYLGLNGLNLCLMCAKVGDQPTLQLKEKDIMDLYNQPEPVKSFLFYHSQSGRNSTFESVAFPGWFIAVSSEGGCPLILTQELGKANTTDFGLTMLF

SEQ ID NO: 795622 - protein, 120 aa, Homo sapiens
YSCKLLASPSVKNSASRSFNSSPKKSPVHSLLTSSVEGSIGSTSQYRSAKPIHSSDSVKDSQSPPIETTGKTCRKLQNRLESLQTLVEDLQLKNQAMSSMIRNQEKRIQKVKDQEKMLLK

SEQ ID NO: 795623 - protein, 124 aa, Homo sapiens
YSCKLLASPSVKNSASRSFNSSPKKSPVHSLLTSSVEGSIGSTSQYRSAKPIHSSDSVKDSQSPPIETTGKTCRKLQNRLESLQTLVEDLQLKNQVCSCSGSWSKSQQCESPHVALSIQVGAAR

SEQ ID NO: 795624 - protein, 353 aa, Homo sapiens
MAHFVQGTSRMIAAESSTEHKECAEPSTRKNLMNSLEQKIRCLEKQRKELLEVNQQWDQQFRSMKELYERKVAELKTKLDAAERFLSTREKDPHQRQRKDDRQREDDRQRDLTRDRLQREEKEKERLNEELHELKEENKLLKGKNTLANKEKEHYECEIKRLNKALQDALNIKCSFSEDCLRKSRVEFCHEEMRTEMEVLKQQVQIYEEDFKKERSDRERLNQEKEELQQINETSQSQLNRLNSQIKACQMEKEKLEKQLKQMYCPPCNCGLVFHLQDPWVPTGPGAVQKQREHPPDYQWYALDQLPPDVQHKANDGVLLHLQSVARLVSNSWPQVILLPLAPKVLKFQVYPQ

SEQ ID NO: 795625 - protein, 325 aa, Homo sapiens
MAHFVQGTSRMIAAESSTEHKECAEPSTRKNLMNSLEQKIRCLEKQRKELLEVNQQWDQQFRSMKELYERKVAELKTKLDAAERFLSTREKDPHQRQRKDDRQREDDRQRDLTRDRLQREEKEKERLNEELHELKEENKLLKGKNTLANKEKEHYECEIKRLNKALQDALNIKCSFSEDCLRKSRVEFCHEEMRTEMEVLKQQVQIYEEDFKKERSDRERLNQEKEELQQINETSQSQLNRLNSQIKACQMEKEKLEKQLKQMYCPPCNCGLVFHLQDPWVPTGPGAVQKQREHPPDYQWYALDQLPPDVQHKANGLSSVKKVHP

SEQ ID NO: 795626 - protein, 32 aa, Homo sapiens
MTQTTHSVSTSPLFSNCEVLIHGQEIKQLSRV

SEQ ID NO: 795627 - protein, 158 aa, Homo sapiens
MAAGPRPGAPCRAGAPTIVLTSGRRQTLSHGSSSPARATLGKPLVLNDLFTELKKYGLHIFQVYMWLIWEAEHSSPNLLVMSATTACWPAFTVLGEARGDQVDWSRLYRDTGLVKMSRKPRASSPFSNNHPSTPKRFPRQPRREKGPVKEVPGTKGSP

SEQ ID NO: 795628 - protein, 153 aa, Homo sapiens
MAAGPRPGAPCRAGAPTIVLTSGRRQTLSHGSSSPARATLGKPLVLNDLFTELKKYGLHIFQVYMWLIWEAEHSSPNLLVMSATTACWPAFTVLGEARGDQVDWSRLYRDTGLVKMSRKPRASSPFSNNHPSTPKRRGRGKHPLIPGPEALSK

SEQ ID NO: 795629 - protein, 175 aa, Homo sapiens
MAAGPRPGAPCRAGAPTIVLTSGRRQTLSHGSSSPARATLGKPLVLNDLFTELKKYGLHIFQVYMWLIWEAEHSSPNLLVMSATTACWPAFTVLGEARGDQVDWSRLYRDTGLVKMSRKPRASSPFSNNHPSTPKRRGRGKHPLIPGPEALSKFPRQPRREKGPVKEVPGTKGSP

SEQ ID NO: 795630 - protein, 175 aa, Homo sapiens; identical to SEQ ID NO: 795629

SEQ ID NO: 795631 - protein, 775 aa, Homo sapiens
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLREQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEMSQMKPHVYDLPVEGNEPPASFHKDTNALPPTVFKDNPMSTPKDSNPEA

SEQ ID NO: 795632 - protein, 775 aa, Homo sapiens; identical to SEQ ID NO: 795631

SEQ ID NO: 795633 - protein, 540 aa, Homo sapiens
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLREQCTELWGPGRRTNPFPCACAKENHFR

SEQ ID NO: 795634 - protein, 124 aa, Homo sapiens
MDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFHRYNEEIR

SEQ ID NO: 795635 - protein, 552 aa, Homo sapiens
EERCRGKLLLTRIGVCQLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLREQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEMSQMKPHVYDLPVEGNEPPASFHKDTNALPPTVFKDNPMSTPKDSNPEA

SEQ ID NO: 795636 - protein, 1203 aa, Homo sapiens
AAAPFPDRPPAHLVSSRRSAPPGSREPRGTGHLHPPLGVSGSSWCLACVSWMPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTTEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAVDPVVIVGRCAATSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIRVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 795637 - protein, 1240 aa, Homo sapiens
AAAPFPDRPPAHLVSSRRSAPPGSREPRGTGHLHPPLGVSGSSWCLACVSWMPCGFSPSPVAHHLVPGPPDTPAQQLRCGWTVGGWLLSLVRGRKPSGDFEWRQGWRGPGEEDWPESPSPKVLMDSAGGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTTEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGGRGPRGASWAAVQARPVASGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIRVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 795638 - protein, 1095 aa, Homo sapiens
MVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTTEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGGRGPRGASWAAVQARPVASGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIRVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 795639 - protein, 1248 aa, Homo sapiens
RPPHSQTGRQPIWLAPAAPRRPGVGSRGEPGTCTRLWEPAWVRVALGPARAVVGASGLQRRWGPGTQAWRRRRTSEAEGRRDRVSGSSWCLACVSWMPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTTEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAVDPVVIVGRCAATSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIRVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 795640 - protein, 1150 aa, Homo sapiens
AAAPFPDRPPAHLVSSRRSAPPGSREPRGTGHLHPPLGGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTTEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAVDPVVHRGPLCSHVLWHAASRSASEVAATLLPATGAASAWARAWEERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIRVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 795641 - protein, 1211 aa, Homo sapiens
AAAPFPDRPPAHLVSSRRSAPPGSREPRGTGHLHPPLGVSGSSWCLACVSWMPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTTEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAVDPVVIVGRCAATSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEVLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIRVILPASSMEEATDCAGFNLIHLVATGISCFLGSGLLTLAVYLSCQHCQRQSQESTLVHPATPNHLHYKGGGTPKNEKYTPMEFKTLNKNNLIPDDRANFYPLQQTNASAGYPPLPGSLYSTQGIPLVRGSEYWELEADLCLEVL

SEQ ID NO: 795642 - protein, 124 aa, Homo sapiens
KAKSADLITDISQLFSSDHLETLPMSFQNNVLRTIGEVAIKTIFPLQTGVGTLANAILFFHNIFPILTEHQMRPTHKILTHMAVANSLVLLSTGIPHTMVSFVLWKPLSSLECKLVFTGLVLTW

SEQ ID NO: 795643 - protein, 113 aa, Homo sapiens
MDSRQAAALLVLLLLIDGGCAEGPGGQQEDQLSAEEDSEPLPPQDAQTSGSLLHYLLQAMERPGRSQAFLFQPQRFGRNTQGSWRNEWLSPRAGEGLNSQFWSLAAPQRFGKK

SEQ ID NO: 795644 - protein, 1023 aa, Homo sapiens
MTLNNCASMKLEVHFQSKQNEDSEEEEQCTISSHWAFQQESKCWSPMGSSDLLAPPSPGLPATSSCESVLTELSATSLPVITVSLPPEPADLPLPGRAPSSSDRPLLSPTQGQEGPQDKAKKRHRNRSFLKHLESLRRKEKSGSQQAEPKHSPATSEKVSKASSFRSCRGFLSAGFYRAKNWAATSAGGSGANTRKAWEAWPVASFRHPQWTHRGDCLVHVPGDHKPGTFPRSLSIESLCPEDGHRLADWQPGRRWGCEGRRGSCGSTGSHASTYDNLPELYPAEPVMVGAEAEDEDDEESGGSYAHLDDILQHVWGLQQRVELWSRAMYPDLGPGDEEEEEATSSVEIATVEVKCQAEALSQMEVPAHGESPAWAQAEVQPAVLAPAQAPAEAEPVAQEEAEAPAPAPAPAPAQDSEQEAHSGGEPTFASSLSVEEGHSISDTVASSSELDSSGNSMNEAEAAGSLAGLQASMPRERRDSGVGASLTRPCRKLRWHSFQNSHRPSLNSESLEINRQFAGQINLLHKGSLLRLTAFMEKYTVPHKQGWVWSMPKFMRRNKTPDYRGQHVFGVPPLIHVQRTGQPLPQSIQQAMRYLRSQCLDQVGIFRKSGVKSRIQNLRQMNETSPDNVCYEGQSAYDVADLLKQYFRDLPEPIFTSKLTTTFLQIYQLLPKDQWLAAAQAATLLLPDENREVLQTLLYFLSDIASAEENQMTAGNLAVCLAPSIFHLNVSKKDSPSPRIKSKRSLIGRPGPRDLSDNMAATQGLSHMISDCKKLFQVPQDMVLQLCSSYSAAELSPPGPALAELRQAQAAGVSLSLYMEENIQDLLRDAAERFKGWMSVPGPQHTELACRKAPDGHPLRLWKASTEVAAPPAVVLHRVLRERALWDEDLLRAQVLEALMPGVELYHYVTDSMAPHPCRDFVVLRMWRSDLPRGGCLLVSQSLDPEQPVPESGVRALMLTSQYLMEPCGLGRSRLTHICRADLRGRSPDWYNKVFGHLCAMEVAKIRDSFPTLQAAGPETKL

SEQ ID NO: 795645 - protein, 53 aa, Homo sapiens
ACQNAAQPQLTYQGAFASNHCHSTFFGGPPTPPYWNEEEALWWEAVSKSTPVD

SEQ ID NO: 795646 - protein, 120 aa, Homo sapiens
MTLWHAEYFELKEIGRPQKQPRKQSLPLISCPSVSCPSFVPEVSHRNQNSSPAQLNLDSPPIKCSTATCAVVPTWSSIHPEMQILMRTVLVTELLSNLCPLVRTSAPGEETELHKVAVWV

SEQ ID NO: 795647 - protein, 202 aa, Homo sapiens
PDLPLLLLLLQALDGQLPRAPPGTPASSAALSPEAGIFINKEDSLLYSTESGQETPKLGTLAEGSLQLHLQDQADRVGSTASRQRQKAEMEQRRQKQLESLEQMEHPDMSLEIHYKAELEKERREQRRARLAHLKSSSTRAQERERGSELSTTSPSGTSLADDDRHSQMIRDQQQQILQQNRLHKQFLEEARKCLREFQNIC

SEQ ID NO: 795648 - protein, 151 aa, Homo sapiens
MSIPFSNTHYRIPQGFGNLLEGLTREILREQPDNIPAFAAAYFESLLEKREKTNFDPAEWGSKVEDRFYNNHAFEEQEPPEKSDPKQEESQISGKEEETSVTILDSSEEDKEKEEVAAVKIQAAFRGHIAREEAKKMKTNSLQNEEKEENK

SEQ ID NO: 795649 - protein, 151 aa, Homo sapiens; identical to SEQ ID NO: 795648

SEQ ID NO: 795650 - protein, 151 aa, Homo sapiens; identical to SEQ ID NO: 795648

SEQ ID NO: 795651 - protein, 151 aa, Homo sapiens; identical to SEQ ID NO: 795648

SEQ ID NO: 795652 - protein, 105 aa, Homo sapiens
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQVRGCGL

SEQ ID NO: 795653 - protein, 221 aa, Homo sapiens
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQAGGQHARGQHAMQFPAELTRDACKTRPRELRLICIYFSNTHFFKDENNSSLLNNYVLGAQLSHGHVNNLRDPVNISFWHNQSLVLLGAPPFPLHPCPSVTLLLNTGLTRPKPVEPSWKSITL

SEQ ID NO: 795654 - protein, 126 aa, Homo sapiens [sequence omitted]

SEQ ID NO: 795655 - protein, 139 aa, Homo sapiens
LLCKVPYSQVSGLRMWMFSKGIILSVTVLQVSSCGTSLKSRGLSCPCSSLAHHRVSFPSFRFTAFDVPSFLNFFHLSLPMEWKPRAGRGLTCLVFHCSWTWLHYFECFLGSEQTLCETPSHFFHIGPALSYKCQNNFCF

SEQ ID NO: 795656 - protein, 126 aa, Homo sapiens [sequence omitted]

SEQ ID NO: 795657 - protein, 207 aa, Homo sapiens
MSTKPDMIQKCLWLEILMGIFIAGTLSLDCNLLNVHLRRVTWQNLRHLSSMSNSFPVECLRENIAFELPQEFLQYTQPMKRDIKKAFYEMSLQAFNIFSQHTFKYWKERHLKQIQIGLDQQAEYLNQCLEEDENENEDMKEMKENEMKPSEARVPQLSSLELRRYFHRIDNFLKEKKYSDCAWEIVRVEIRRCLYYFYKFTALFRRK

SEQ ID NO: 795658 - protein, 135 aa, Homo sapiens
MKVVLPGPKSLSSGPLRKASQATATQTPAQGCTVAMETVGRGTGEGVRLPLRRRTREQPRRSGTAEIQAQGARSDAARAPGKLRLLPPTPLQVHSAPPPCTWLRCRVTQACVRERGRELSWKADTDSEGWLDWSR

SEQ ID NO: 795659 - protein, 524 aa, Homo sapiens
MAKRPGPPGSREMGLLTFRDIAIEFSLEEWQCLDCAQRNLYRHVMLENYRNLVSLGIAVSKPDLITCLEQNKESQNIKRNEMVAKRPVTHSHFTQDLQPEQGIKDSLQKVIPRTYGKCGHEKLQFKKCCKSVGECEVPKRGYSEVNQCLSTTQNKIFQTHKYVKVFGKFSNSNRDKTRYTGKKHFKCNKYGKSFCMLSHLNQHQVIHTREKSYKCKECGKSFNCSSNHTTHKIIHTGEKPYRCEECGKAFSWSANLTRHKRIHTGEKPYTCEECGQAFRRSSALTNHKRIHTGGRPYKCEECGKAFSVSSTLTDHKRIHTGEKPCRCEECGKAFSWSSNLTRHKRIHTREKPYACEECGQAFSLSSNLTRHKRIHTGEKPYTYEECGQDFRRSSALTIHKRIHTGERPYKCEECGKVFSLSSTLTDHKRIHTGERPYKCEECGKAFSLSSTLTDHKRIHTGERPYTCEECGKAFNCSSTLMQHKRIHTGEKPYKCEECDQAFKWHSSLAKHKIIHTGEKPYKCE

SEQ ID NO: 795660 - protein, 114 aa, Homo sapiens
GAAASQGRSRWPLANSLDSTSGLLGSSRSPHLEEGEGWSNRTALGLGGVWNPSPQWLRASVLQRGLLSSWECRGEKPVSARVQHCGRVGTVVLFLFEMEPHSVTQAGVQWCNLS

SEQ ID NO: 795661 - protein, 68 aa, Homo sapiens
HSHPDTLDQWFSTCNDCAPPGDISLCLEMHLAVTARRQGMTGTQWVKTRVAAKHPTMHRKAPYSQIII

SEQ ID NO: 795662 - protein, 67 aa, Homo sapiens
LPVGGGGDGAVGGRLAARASPAGLEDRKKRHRRVLEAGAGACASAARLAAVGGEIRDRSSATVVEMW

SEQ ID NO: 795663 - protein, 67 aa, Homo sapiens; identical to SEQ ID NO: 795662

SEQ ID NO: 795664 - protein, 67 aa, Homo sapiens; identical to SEQ ID NO: 795662

SEQ ID NO: 795665 - protein, 110 aa, Homo sapiens
MIRTAITYKAANPSLEGKKINTSCQSFGCTTGTLKQYEPFFVIGYINALSLKSESILLVRDCLLKLLGFFFFFFEMEFHSFRLGWSAVAHSPLTATSSSWVLAILLPQPP

SEQ ID NO: 795666 - protein, 102 aa, Homo sapiens
LNFKGLAVSPSLEYSGMIWVHCNLCLPGSDHPPASASQSVGITGVSLAPGIISESESESPELWRLWSSHSCFGIHASSLSAGATPHHTQDGVCCFSRCDAKL

SEQ ID NO: 795667 - protein, 219 aa, Homo sapiens
RSGVSRRNSTAMGEPAFTSFPSLPVLGKLKRNMMPWALQKKREIHMAKAHRRRAARSALPMRLTSCIFRRPVTRIRSHPDNQVRRRKGDEHLEKPQQLCAYRRLQALQPCSSQGEGSSPLHLESVLSILAPGTASESLDRAGAERVRSPLEPTPGRFPAVAGGPTPGMGCQLPPPLSGQLVTPADIRRQARRVKKARERLAKALQADRLARQAEMLTCR

SEQ ID NO: 795668 - protein, 111 aa, Homo sapiens
HRKVCGQLPEGSRVLNPDAILTHRSHGNKNKNSYENSSWPKTCHAFPHLIIPRSLEFSHFTGEERVFRMAKGLTPLKEEHALSSKNVPKLNRRSESKACAPPTAACGGLFP

SEQ ID NO: 795669 - protein, 120 aa, Homo sapiens [sequence omitted]

SEQ ID NO: 795670 - protein, 69 aa, Homo sapiens
AYARMQCRVCIPKADEILQNGCLTRQSQEDRPRRERLMCLHYQEIGFSKPARHPIQQYETGHISLRCQR

SEQ ID NO: 795671 - protein, 109 aa, Homo sapiens
SGEEGVLFSPLRTSELAALTSSETHVLSHGHRFSPAVWPYAPAYHSHPRRPVLGGEALVSDLSALKSYPALMATPRLGGTSNIAVEGPMFAFCTLPSLTLDTIKTIFSS

SEQ ID NO: 795672 - protein, 99 aa, Homo sapiens
MRLREPCVEGGEYGIPPCNPQLKQFLPYILPIQEFAILAISFGKGISRMGRKMFGHAEGIREEMTAIPRDKNICMEATKTAHDEAKHMSSISKKEGAEA

SEQ ID NO: 795673 - protein, 102 aa, Homo sapiens
AAGPPSAAYICSPPALSSQEAPHLSLPEEYGSQGGLLQAFLSTHALPPSLPASKELISRETLPSCPTFPSASSRNCPLTSLCLGLLVTLVHTKTVLPFPVSH

SEQ ID NO: 795674 - protein, 155 aa, Homo sapiens
MKIAEFLNRETKASANLSETVTKPPLPQKNTAQVGASSQTRKPNKLAPHPAVPAFVKNTCPSRPRERQTHFLRPRPEDRMVALKPIEIVLPPVFMPFSSPQGIRSRMPTQHLYCRWVAPKALVPTCLPTHSLSRKEEKPKDDTPSSLLRPPRRWL

SEQ ID NO: 795675 - protein, 116 aa, Homo sapiens
MAPYRVLPYCWKGMTPEQQAAIRKEQEVQRSKKQAHRQAEKTLDTEWKSQTMSSAQAVLELEEQERELCAVFQRGLGSFNQQLANEQKAQQDYLNSVIYTNQPTAQYHQQFNTSSR

SEQ ID NO: 795676 - protein, 108 aa, Homo sapiens
HQSTSDLLTETPRVAQHPMAPYRVLPYCWKGMTPEQQAAIRKEQEVQRSKKQAHRQAEKTLDTEWKSQTMSSAQAVLELEEQERELCAVFQRGLGSFNQQLANEQKAQ

SEQ ID NO: 795677 - protein, 177 aa, Homo sapiens
LCGLVPEGTLPGAPWRGAVALAAEVPERTVAQWLAEACTQPPEEFVWAVALLLLQLSAALKFLEAWGAALVELRPENLLLVAPRGCATTGPPRLLLTDFGRVCLQPPGPPGSPGPHAPQLGSLLRALLSLAAPSTTPLAAGLELLAAQLTRLRPSASRTRGALQALLWGPGPELRGR

SEQ ID NO: 795678 - protein, 83 aa, Homo sapiens
GEKSTTNHILADKLNWMWFIKDIPKPQNWISRVHLWPRVHNHTPRHRHGSWFMRYPRTQDSDPDCRPVPGEKQRVPPPHRPPS

SEQ ID NO: 795679 - protein, 70 aa, Homo sapiens
EKRKHKKKLLVQSPNSYFMDVKCPGCDKITTVFSHAQTVVLCVGCSTVLCQPTGGKARLTEGCSFRRKQH

SEQ ID NO: 795680 - protein, 72 aa, Homo sapiens
CIVLAGARQKTPKESYPLSRGEVKLISNCSKSYGNRLYDKEMDVQSLALCPKLECSGAISAHCNIHPPPGFK

SEQ ID NO: 795681 - protein, 159 aa, Homo sapiens
VKWGDHCHPTEPGAWCCWTARTPKAKSWAPWGPPCQALPWDAALASSQGPAPPPTTPCSQDPHLSVHQNYLGSFINVKAQAPPRNSESGACPGLQMLYVARTGAPGFPTTHVVQPSRYTLQRPFLVLTPAHFPVAQTWPQDKAARPTLQGRPSHTCHCI

SEQ ID NO: 795682 - protein, 126 aa, Homo sapiens
RRLLAEKEELLSENRIITEKLHKCLEEAAHTEMSLNEKITYLTSEKEMASQKMTELKKQQDSLLKEKSSLETQNGALLAERENSIKAIGDLKRQCDQESANRSLVVQENMKLLGNIDALKKELQER

SEQ ID NO: 795683 - protein, 117 aa, Homo sapiens
LRWCTHMPGRLVLAVGGRPQFPTTWTPLQSCLSVLTTWQLAAPEEVIQGEQGRNHVFYGLALDIISAVLLVARWVLFSEEGTLQDVTTGAHWAASQSCHHAAAWLAHLEHLVFSHLV

SEQ ID NO: 795684 - protein, 314 aa, Homo sapiens
MDAFKGGMSLERLPEGLRPPPPPPHDMGPAFHLARPADPREPLENSASESSDTELPEKERGGEPKGPEDSGAGGTGCGGADDPAKKKKQRRQRTHFTSQQLQELEATFQRNRYPDMSMREEIAVWTNLTEPRVRVWFKNRRAKWRKRERNQQLDLCKGGYVPQFSGLVQPYEDVYAAGYSYNNWAAKSLAPAPLSTKSFTFFNSMSPLSSQSMFSAPSSISSMTMPSSMGPGAVPGMPNSGLNNINNLTGSSLNSAMSPGACPYGTPASPYSVYRDTCNSSLASLRLKSKQHSSFGYGGLQGPASGLNACQYNS

SEQ ID NO: 795685 - protein, 70 aa, Homo sapiens
GRRPLDEDTAGSCRNGPRALPPPRRWLEGARSVRSCSANIHSSWAVLARAGDFEAAETGVDSRRNKSFEA

SEQ ID NO: 795686 - protein, 314 aa, Homo sapiens; identical to SEQ ID NO: 795684

SEQ ID NO: 795687 - protein, 293 aa, Homo sapiens
ARGGPHVMGWRRRRPADPREPLENSASESSDTELPEKERGGEPKGPEDSGAGGTGCGGADDPAKKKKQRRQRTHFTSQQLQELEATFQRNRYPDMSMREEIAVWTNLTEPRVRVWFKNRRAKWRKRERNQQLDLCKGGYVPQFSGLVQPYEDVYAAGYSYNNWAAKSLAPAPLSTKSFTFFNSMSPLSSQSMFSAPSSISSMTMPSSMGPGAVPGMPNSGLNNINNLTGSSLNSAMSPGACPYGTPASPYSVYRDTCNSSLASLRLKSKQHSSFGYGGLQGPASGLNACQYNS

SEQ ID NO: 795688 - protein, 354 aa, Homo sapiens
RSRDPAHVRGRSPEQPGSGPRPGSCASPSALPFFVRAGAFFQQRTGPAGGRRGQWGSESAAQRSRPGSGGAPSSPVWAPLLRSFLNTQLNVSLHFLKKERGGEPKGPEDSGAGGTGCGGADDPAKKKKQRRQRTHFTSQQLQELEATFQRNRYPDMSMREEIAVWTNLTEPRVRVWFKNRRAKWRKRERNQQLDLCKGGYVPQFSGLVQPYEDVYAAGYSYNNWAAKSLAPAPLSTKSFTFFNSMSPLSSQSMFSAPSSISSMTMPSSMGPGAVPGMPNSGLNNINNLTGSSLNSAMSPGACPYGTPASPYSVYRDTCNSSLASLRLKSKQHSSFGYGGLQGPASGLNACQYNS

SEQ ID NO: 795689 - protein, 246 aa, Homo sapiens
MDAFKGGMSLERLPEGLRPPPPPPHDMGPAFHLARPADPREPLENSASESSDTELPEKERGGEPKGPEDSGAGGTGCGGADDPAKKKKQRRQRTHFTSQQLQELEATFQRNRYPDMSMREEIAVWTNLTEPRVRVWFKNRRAKWRKRERNQQLDLCKGGYVPQFSGLVQPYEDVYAAGYSYNNWAAKSLAPAPLSTKSFTFFNSMSPLSSQSMFSSLLKHSPALASAGPHVSHACVTRYPRSCRGL

SEQ ID NO: 795690 - protein, 314 aa, Homo sapiens; identical to SEQ ID NO: 795684

SEQ ID NO: 795691 - protein, 288 aa, Homo sapiens [sequence omitted]

SEQ ID NO: 795692 - protein, 283 aa, Homo sapiens
AVRWSRDGVQRGVSPGDPLPVLPTAEKERGGEPKGPEDSGAGGTGCGGADDPAKKKKQRRQRTHFTSQQLQELEATFQRNRYPDMSMREEIAVWTNLTEPRVRVWFKNRRAKWRKRERNQQLDLCKGGYVPQFSGLVQPYEDVYAAGYSYNNWAAKSLAPAPLSTKSFTFFNSMSPLSSQSMFSAPSSISSMTMPSSMGPGAVPGMPNSGLNNINNLTGSSLNSAMSPGACPYGTPASPYSVYRDTCNSSLASLRLKSKQHSSFGYGGLQGPASGLNACQYNS

SEQ ID NO: 795693 - protein, 159 aa, Homo sapiens [sequence omitted]

SEQ ID NO: 795694 - protein, 88 aa, Homo sapiens
PLFLVCETVTDLVPALTESLLGSRNGTYLVHTFLCCLGPRAASPLCYKNAVVPNNCLLLGDWLYDCSQLRNGVVIPEVSVVHNAEVGS

SEQ ID NO: 795695 - protein, 117 aa, Homo sapiens
GSSDSHTSASPVAAITDTHHHTQLIFYIFSRGKVLPYWPGWSGTPDLKRSACFPKYWDYRRERPHLANFYFKTMRGVHGRAVVSNPGCVRVVPTPSVPLFLPSREFSYGSTRMTSSP

SEQ ID NO: 795696 - protein, 120 aa, Homo sapiens
LWKLLVRSLHVWPPGLRAYREVSSMLLGGQRSQLRSLPPSGGGSRGVGSLLLQPCFPPCDPPRVPSVSHLMSTLCPALCPVCVPPCVCPLFTLCPSRARLCPPSSSSLGAAPTHLPSQPL

SEQ ID NO: 795697 - protein, 80 aa, Homo sapiens
SFELSMGFHSAQKFQLHTRDDEAATQKHRQRCGAQSKPWGEIFSPGLHQDESISSPPSSKAKLALQPSMQETGFCLVPAL

SEQ ID NO: 795698 - protein, 130 aa, Homo sapiens [sequence omitted]

SEQ ID NO: 795699 - protein, 770 aa, Homo sapiens
MVESAGRAGQKRPGFLEGGLLLLLLLVTAALVALGVLYADRRGKQLPRLASRLCFLQEERTFVKRKPRGIPEAQEVSEVCTTPGCVIAAARILQNMDPTTEPCDDFYQFACGGWLRRHVIPETNSRYSIFDVLRDELEVILKAVLENSTAKDRPAVEKARTLYRSCMNQSVIEKRGSQPLLDILEVVGGWPVAMDRWNETVGLEWELERQLALMNSQFNRRVLIDLFIWNDDQNSSRHIIYIDQPTLGMPSREYYFNGGSNRKVREAYLQFMVSVATLLREDANLPRDSCLVQEDMVQVLELETQLAKATVPQEERHDVIALYHRMGLEELQSQFGLKGFNWTLFIQTVLSSVKIKLLPDEEVVVYGIPYLQNLENIIDTYSARTIQNYLVWRLVLDRIGSLSQRFKDTRVNYRKALFGTMVEEVRWRECVGYVNSNMENAVGSLYVREAFPGDSKSMVRELIDKVRTVFVETLDELGWMDEESKKKAQEKAMSIREQIGHPDYILEEMNRRLDEEYSNLNFSEDLYFENSLQNLKVGAQRSLRKLREKVDPNLWIIGAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVNGFNTLGENIADNGGVRQAYKAYLKWMAEGGKDQQLPGLDLTHEQLFFINYAQVWCGSYRPEFAIQSIKTDVHSPLKYRVLGSLQNLAAFADTFHCARGTPMHPKERCRVW

SEQ ID NO: 795700 - protein, 114 aa, Homo sapiens
MCRASTPHGCDVGQPVPRKGSWHSKGWPDMCIPTLSELWGERVSVWKEQASVLFPQSSQQTQSLVQGLDAPVLMGSGTRLPPLARSLAPSAWSAPTLGTWAVDTAPGPQLPCQR

SEQ ID NO: 795701 - protein, 202 aa, Homo sapiens
HKQNLQNRFSFPSHQLLELELSAMAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 795702 - protein, 123 aa, Homo sapiens [sequence omitted]

SEQ ID NO: 795703 - protein, 318 aa, Homo sapiens
VRTVALDHGRPAFPPPVLGVGPSQPPLLTFCPILEPQVLCPFPIIAKLMMLRLLSSLLLVAVASGYGPPSSRPSSRVVNGEDAVPYSWPWQVSLQYEKSGSFYHTCGGSLIAPDWVVTAGHCISSSWTYQVVLGEYDRAVKEGPEQVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEETIASH

SEQ ID NO: 795704 - protein, 150 aa, Homo sapiens
GRSYCHSHTRRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEETIASH

SEQ ID NO: 795705 - protein, 177 aa, Homo sapiens
VRTVALDHGRPAFPPPVLGVGPSQPPLLTFCPILEPQVLCPFPIIAKLMMLRLLSSLLLVAVACYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEETIASH

SEQ ID NO: 795706 - protein, 135 aa, Homo sapiens
AGERLLSSLLLVAVASGYGPPSSRPSSRVVNGEDAVPYSWPWQVSLQYEKSGSFYHTCGGSLIAPDWVVTAGHCISSSWTYQVVLGEYDRAVKEGPEQVIPINSGDLFVHPLWNRSCVACGNDIALIKLSTIASH

SEQ ID NO: 795707 - protein, 86 aa, Homo sapiens
KEKKNPPPHGGVGGGPWEKGGTKPGSGVANGDSGGPLNCPTEDGGWQVHGVTSFVSAFGCNTRRKPTVFTRVSAFIDWIEETIASH

SEQ ID NO: 795708 - protein, 318 aa, Homo sapiens; identical to SEQ ID NO: 795703

SEQ ID NO: 795709 - protein, 318 aa, Homo sapiens; identical to SEQ ID NO: 795703

SEQ ID NO: 795710 - protein, 318 aa, Homo sapiens; identical to SEQ ID NO: 795703

SEQ ID NO: 795711 - protein, 325 aa, Homo sapiens
VRTVALDHGRPAFPPPVLGVGPSQPPLLTFCPILEPQVLCPFPIIAKLMMLRLLSSLLLVAVASGYGPPSSRPSSRVVNGEDAVPYSWPWQVSLQYEKSGSFYHTCGGSLIAPDWVVTAGHCISSSWTYQVVLGEYDRAVKEGPEQVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEEKLQGNKAPESRT

SEQ ID NO: 795712 - protein, 286 aa, Homo sapiens
MRSCYVAQAGLKLPGSSDPPASASQSTRITASGYGPPSSRPSSRVVNGEDAVPYSWPWQVSLQYEKSGSFYHTCGGSLIAPDWVVTAGHCISSSWTYQVVLGEYDRAVKEGPEQVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEETIASH

SEQ ID NO: 795713 - protein, 270 aa, Homo sapiens
AGERLLSSLLLVAVASGYGPPSSRPSSRVVNGEDAVPYSWPWQVSLQYEKSGSFYHTCGGSLIAPDWVVTAGHCISSSWTYQVVLGEYDRAVKEGPEQVIPINSGDLFVHPLWNRSCVACGNDIALIKLSRSAQLGDAVQLASLPPAGDILPNETPCYITGWGRLYTNGPLPDKLQEALLPVVDYEHCSRWNWWGSSVKKTMVCAGGDIRSGCNGDSGGPLNCPTEDGGWQVHGVTSFVSAFGCNTRRKPTVFTRVSAFIDWIEETIASH

SEQ ID NO: 795714 - protein, 74 aa, Homo sapiens
LLHPSHPAAAARMASGYRRTHNCPKSPSAPFLPCTTSAFTAVQESPYSFLTTPQWKGSCYHLILWMTKLRHRVD

SEQ ID NO: 795715 - protein, 45 aa, Homo sapiens
LILINSHQFLTFRDVCDQSSYEENSKCCMAKNPRTPGPNRMQLPT

SEQ ID NO: 795716 - protein, 102 aa, Homo sapiens
DVGRQLNSAPGKMEAAETEAEAAALEVLAEVAGILEPVGLQEEAELPAKILVEFVVDSQKKDKLLCSQLQVADFLQNILAQEDTGVSFKAVGLQPAGDVNLP

SEQ ID NO: 795717 - protein, 252 aa, Homo sapiens
DVGRQLNSAPGKMEAAETEAEAAALEVLAEVAGILEPVGLQEEAELPAKILVEFVVDSQKKDKLLCSQLQVADFLQNILAQEDTAKGLDPLASEDTSRQKAIAAKEQWKELKATYREHVEAIKIGLTKALTQMEEAQRKRTQLREAFEQLQAKKQMAMEKRRAVQNQWQLQQEKHLQHLAEVSAEVRERKTGTQQELDGVFQKLGNLKQQAEPGADKLQRYQTFLQVLYTCRIGVSWSDVEKISNDNQSDYH

SEQ ID NO: 795718 - protein, 118 aa, Homo sapiens
DVGRQLNSAPGKMEAAETEAEAAALEVLAEVAGILEPVGLQEEAELPAKILVEFVVDSQKKDKLLCSQLQVADFLQNILAQEDTAKGLDPLASEDTSRQKAIAAEAENLPDDKPQQRT

SEQ ID NO: 795719 - protein, 101 aa, Homo sapiens
ARKEMQIKTTVGHHYIYKLIGKNLSLEIPSVGEKVEQLELSTKLLRVQTSTAALEGSSASSAKVEGVYPLWHSSSSVTCVLTDTSIYVHQHNVCKNLRWHV

SEQ ID NO: 795720 - protein, 126 aa, Homo sapiens [sequence omitted]

SEQ ID NO: 795721 - protein, 70 aa, Homo sapiens [sequence omitted]

SEQ ID NO: 795722 - protein, 232 aa, Homo sapiens
SSAGLGAPSRPRLLPGAAPLPLGRPVVAGYGKLALNLVPGHNKDEFVFLALVEHMGPHSHPVRLERLLQRERHGGSGFSPRGRAAGPARPRTPRWLRRAPRSPSPGAFSHLSAPAGSPGSFACPSAPRPPSSFVARIERRTISVPGAGSSHGHLRPDLFTSSALPQRLAAARRPPREAVELRLRRSGGEARVPRGQAGAVCVPVARPGQDPRPRPWCCCRKPGAGLTDEPVS

SEQ ID NO: 795723 - protein, 1944 aa, Homo sapiens
MSNFYEERTTMIAARDLQEFVPFGRDHCKHHPNALNLQLRQLQPASELWSSDGAAGLVGSLQEVTIHEKQKESWQLRKGVSEIGEDVDYDEELYVAGNMVIWSKGSKSQALAVYKAFTVDSPVQQALWCDFIISQDKSEKAYSSNEVEKCICILQSSCINMHSIEGKDYIASLPFQVANVWPTKYGLLFERSASSHEVPPGSPREPLPTMFSMLHPLDEITPLVCKSGSLFGSSRVQYVVDHAMKIVFLNTDPSIVMTYDAVQNVHSVWTLRRVKSEEENVVLKFSEQGGTPQNVATSSSLTAHLRSLSKGDSPVTSPFQNYSSIHSQSRSTSSPSLHSRSPSISNMAALSRAHSPALGVHSFSGVQRFNISSHNQSPKRHSISHSPNSNSNGSFLAPETEPIVPELCIDHLWTETITNIREKNSQASKVFITSDLCGQKFLCFLVESQLQLRCVKFQESNDKTQLIFGSVTNIPAKDAAPVEKIDTMLVLEGSGNLVLYTGVVRVGKVFIPGLPAPSLTMSNTMPRPSTPLDGVSTPKPLSKLLGSLDEVVLLSPVPELRDSSKLHDSLYNEDCTFQQLGTYIHSIRDPVHNRVTLELSNGSMVRITIPEIATSELVQTCLQAIKFILPKEIAVQMLVKWYNVHSAPGGPSYHSEWNLFVTCLMNMMGYNTDRLAWTRNFDFEGSLSPVIAPKKARPSETGSDDDWEYLLNSDYHQNVESHLLNRSLCLSPSEASQMKDEDFSQNLSLDSSTLLFTHIPAIFFVLHLVYEELKLNTLMGEGICSLVELLVQLARDLKLGPYVDHYYRDYPTLVRTTGQVCTIDPGQTGFMHHPSFFTSEPPSIYQWVSSCLKGEGMPPYPYLPGICERSRLVVLSIALYILGDESLVSDESSQYLTRITIAPQKLQVEQEENRFSFRHSTSVSSLAERLVVWMTNVGFTLRDLETLPFGIALPIRDAIYHCREQPASDWPEAVCLLIGRQDLSKQACEGNLPKGKSVLSSDVPSGTETEEEDDGMNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIHIPALLPPTSTELDVPHNVQVAAVVGIGLVYQGTAHRHTAEVLLAEIGRPPGPEMEYCTDRESYSLAAGLALGMVCLGHGSNLIGMSDLNVPEQLYQYMVGGHRRFQTGMHREKHKSPSYQIKEGDTINVDVTCPGATLALAMIYLKTNNRSIADWLRAPDTMYLLDFVKPEFLLLRTLARCLILWDDILPNSKWVDSNVPQIIRENSISLSEIELPCSEDLNLETLSQAHVYIIAGACLSLGFRFAGSENLSAFNCLHKFAKDFMTYLSAPNASVTGPHNLETCLSVVLLSLAMVMAGSGNLKVLQLCRFLHMKTGGEMNYGFHLAHHMALGLLFLGGGRYSLSTSNSSIAALLCALYPHFPAHSTDNRYHLQALRHLYVLAAEPRLLVPVDVDTNTPCYALLEVTYKGTQWYEQTKEELMAPTLLPELHLLKQIKVKGPRYWELLIDLSKGTQHLKSILSKDGVLYVKLRAGQLSYKEDPMGWQSLLAQTVANRNSEARAFKPETISAFTSDPALLSFAEYFCKPTVNMGQKQEILDLFSSVLYECVTQETPEMLPAYIAMDQAIRRLGRREMSETSELWQIKLVLEFFSSRSHQERLQNHPKRGLFMNSEFLPVVKCTIDNTLDQWLQVGGDMCVHAYLSGQPLEESQLSMLACFLVYHSVPAPQHLPPIGLEGSTSFAELLFKFKQLKMPVRALLRLAPLLLGNPQPMVM

SEQ ID NO: 795724 - protein, 72 aa, Homo sapiens
HEASCRVHLNVSHAFLPLALEPAAVARSSSGIREGEGMISCCGPRVTVKDPAAALGPPRPLRLRGAAGARRA

SEQ ID NO: 795725 - protein, 2062 aa, Homo sapiens
KGTFAHLSELDCDKPHVDPENFKLLGNVLVTALAIQVLYSIPKEVSTFLPCALTLGLPMMEEAEDRLSKLSKNLWVHVVDNQEPSQGLTSSIFHIHHAPQACDRRTELYRNNVDIWKPMSNFYEERTTMIAARDLQEFVPFGRDHCKHHPNALNLQLRQLQPASELWSSDGAAGLVGSLQEVTIHEKQKESWQLRKGVSEIGEDVDYDEELYVAGNMVIWSKGSKSQALAVYKAFTVDSPVQQALWCDFIISQDKSEKAYSSNEVEKCICILQSSCINMHSIEGKDYIASLPFQVANVWPTKYGLLFERSASSHEVPPGSPREPLPTMFSMLHPLDEITPLVCKSGSLFGSSRVQYVVDHAMKIVFLNTDPSIVMTYDAVQNVHSVWTLRRVKSEEENVVLKFSEQGGTPQNVATSSSLTAHLRSLSKGDSPVTSPFQNYSSIHSQSRSTSSPSLHSRSPSISNMAALSRAHSPALGVHSFSGVQRFNISSHNQSPKRHSISHSPNSNSNGSFLAPETEPIVPELCIDHLWTETITNIREKNSQASKVFITSDLCGQKFLCFLVESQLQLRCVKFQESNDKTQLIFGSVTNIPAKDAAPVEKIDTMLVLEGSGNLVLYTGVVRVGKVFIPGLPAPSLTMSNTMPRPSTPLDGVSTPKPLSKLLGSLDEVVLLSPVPELRDSSKLHDSLYNEDCTFQQLGTYIHSIRDPVHNRVTLELSNGSMVRITIPEIATSELVQTCLQAIKFILPKEIAVQMLVKWYNVHSAPGGPSYHSEWNLFVTCLMNMMGYNTDRLAWTRNFDFEGSLSPVIAPKKARPSETGSDDDWEYLLNSDYHQNVESHLLNRSLCLSPSEASQMKDEDFSQNLSLDSSTLLFTHIPAIFFVLHLVYEELKLNTLMGEGICSLVELLVQLARDLKLGPYVDHYYRDYPTLVRTTGQVCTIDPGQTGFMHHPSFFTSEPPSIYQWVSSCLKGEGMPPYPYLPGICERSRLVVLSIALYILGDESLVSDESSQYLTRITIAPQKLQVEQEENRFSFRHSTSVSSLAERLVVWMTNVGFTLRDLETLPFGIALPIRDAIYHCREQPASDWPEAVCLLIGRQDLSKQACEGNLPKGKSVLSSDVPSGTETEEEDDGMNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIHIPALLPPTSTELDVPHNVQVAAVVGIGLVYQGTAHRHTAEVLLAEIGRPPGPEMEYCTDRESYSLAAGLALGMVCLGHGSNLIGMSDLNVPEQLYQYMVGGHRRFQTGMHREKHKSPSYQIKEGDTINVDVTCPGATLALAMIYLKTNNRSIADWLRAPDTMYLLDFVKPEFLLLRTLARCLILWDDILPNSKWVDSNVPQIIRENSISLSEIELPCSEDLNLETLSQAHVYIIAGACLSLGFRFAGSENLSAFNCLHKFAKDFMTYLSAPNASVTGPHNLETCLSVVLLSLAMVMAGSGNLKVLQLCRFLHMKTGGEMNYGFHLAHHMALGLLFLGGGRYSLSTSNSSIAALLCALYPHFPAHSTDNRYHLQALRHLYVLAAEPRLLVPVDVDTNTPCYALLEVTYKGTQWYEQTKEELMAPTLLPELHLLKQIKVKGPRYWELLIDLSKGTQHLKSILSKDGVLYVKLRAGQLSYKEDPMGWQSLLAQTVANRNSEARAFKPETISAFTSDPALLSFAEYFCKPTVNMGQKQEILDLFSSVLYECVTQETPEMLPAYIAMDQAIRRLGRREMSETSELWQIKLVLEFFSSRSHQERLQNHPKRGLFMNSEFLPVVKCTIDNTLDQWLQVGGDMCVHAYLSGQPLEESQLSMLACFLVYHSVPAPQHLPPIGLEGSTSFAELLFKFKQLKMPVRALLRLAPLLLGNPQPMVM

SEQ ID NO: 795726 - protein, 131 aa, Homo sapiens
GKMTSPPRGPGTHRTAELARAEELLEQQLELYQALLEGQEGAWEAQALVLKIQKLKEQMRRHHGCCSQNPKASMEEQTNSRGNGKMTSPPRGPGTHRTAELAGSAVLVPFPFDLTAGRAPRPYRNSPWTMP

SEQ ID NO: 795727 - protein, 109 aa, Homo sapiens
AARSAPECPGLVSLGCGPGHRALCSSEVIPAHSPGQAQRSATIGTQQRAAAISNNGSSNAQRTHGADTHQMKTRRPERWGSPGAAQRVRGQPWAEPGHTLPQGFTVSPK

SEQ ID NO: 795728 - protein, 81 aa, Homo sapiens
ILFTFFIESKTRRIFQVLLTRTEQIQVAIVAKPLVHVWRDQRGHPHVVMPQASGALDQSQCSPWQLVKHNLGQMEALAMSR

SEQ ID NO: 795729 - protein, 348 aa, Homo sapiens
MLHSSFPTSHPHPYPIPSSRPLPPAPCSCPVLALPPHLPAASHRARKAGTQTLASAQAPVQTPAPTLPGPALPGPFPGGRVVRLHPVLLASTVDSYERRNKGAARVIGTLLGTVNKHSVEVTNCFSVSYNESDEVVVDMEFAKNMYELHKKVSPNELILGWYAAGHDITEHSVLIHEYYSREAPNPIHLTVDTSLQNGHMSIKAYVSTLMGVPGRTVGVFTPLTVKYAYYDTECIRVDLIMKTCFSPNRVVGLSSDLQQVGGASAHIQDALSIVLQYAEDILSAKVSADNTIRKVGHFLMSLVNQVPKIVPDDFETMLHSNINDLLMVAYLANLTQSQIALNEKRVNL

SEQ ID NO: 795730 - protein, 445 aa, Homo sapiens
TATASSPPQTPSQGARWRPRALARVPARRLRKPGMNAETCVSYCESPAAAMDAYYSPVSQSREGSSPFRAFPGGDKFGTTFLSAAAKAQGFGDAKSRARYGAGQQDLATPLESGAGARGSFNKFQPQPSTPQPQPPPQPQPQQQQPQPQPPAQPHLYLQRGACKTPPDGSLKLQEGSSGHSAALQVPCYAKESSLGEPELPPDSDTVGMDSSYLSVKEAGVKGPQDRASSDLPSPLEKADSESNKGKKRRNRTTFTSYQLEELEKVFQKTHYPDVYAREQLAMRTDLTEARVQVWFQNRRAKWRKRERFGQMQQVRTHFSTAYELPLLTRAENYAQIQNPSWLGNNGAASPVPACVVPCDPVPACMSPHAHPPGSGASSVTDFLSVSGAGSHVGQTHMGSLFGAASLSPGLNGYELNGEPDRKTSSIAALRMKAKEHSAAISWAT

SEQ ID NO: 795731 - protein, 769 aa, Homo sapiens
PLQEGEVGSEISPREVHFPGTLPFPRRRRGKMTKFQEAVTFKDVAVAFTEEELGLLDSAQRKLYRDVMLENFRNLVSVGHQSFKPDMISQLEREEKLWMKELQTQRGKHSGDRNQNEMATLHKAGLRCFSLGELSCWQIKRHIASKLARSQDSTINIEGKSSQFPKHHDSPCQVGAGESIQASVDDNCLVNHIGDHSSIIENQEFPTGKVPNSWSKIYLNETQNYQRSCKQTQMKNKLCIFAPYVDIFSCISHHHDDNIVHKRDKVHSNSDCGKDTLKVSPLTQRSIHTGQKTYQGNECEEAFNDSSSLELHKQVHLGKKSPACSTHEKDTSYSSGIPVQQSVRTGKKRYWCHECGKGFSQSSNLQTHQRVHTGEKPYTCHECGKSFNQSSHLYAHLPIHTGEKPYRCDSCGKGFSRSTDLNIHCRVHTGEKPYKCEVCGKGFTQRSHLQAHERIHTGEKPYKCGDCGKRFSCSSNLHTHQRVHTEEKPYKCDECGKCFSLSFNLHSHQRVHTGEKPYKCEECGKGFSSASSFQSHQRVHTGEKPFRCNVCGKGFSQSSYFQAHQRVHTGEKPYKCEVCGKRFNWSLNLHNHQRVHTGEKPYKCEECGKGFSQASNLQAHQSVHTGEKPFKCDACQKRFSQASHLQAHQRVHTGEKPYKCDTCGKAFSQRSNLQVHQIIHTGEKPFKCEECGKEFSWSAGLSAHQRVHTGEKPYTCQQCGKGFSQASHFHTHQRVHTGERPYICDVCCKGFSQRSHLIYHQRVHTGGNL

SEQ ID NO: 795732 - protein, 112 aa, Homo sapiens
PLQEGEVGSEISPREVHFPGTLPFPRRRRGKMTKFQEAVTFKDVAVAFTEEELGLLDSAQRKLYRDVMLENFRNLVSVGHQSFKPDMISQLEREEKLWMKELQTQRGKHSET

SEQ ID NO: 795733 - protein, 118 aa, Homo sapiens
PLQEGEVGSEISPREVHFPGTLPFPRRRRGKMTKFQEAVTFKDVAVAFTEEELGLLDSAQRKLYRDVMLENFRNLVSVGHQSFKPDMISQLEREEKLWMKELQTQRGKHSGFLCCVFS

SEQ ID NO: 795734 - protein, 112 aa, Homo sapiens; identical to SEQ ID NO: 795732

SEQ ID NO: 795735 - protein, 235 aa, Homo sapiens
MLSLLLLALPVLASPAYVAPAPGQALQQTGIVGGQEAPRSKWPWQVSLRVRGPYWMHFCGGSLIHPQWVLTAAHCVEPDIKDLAALRVQLREQHLYYQDQLLPVSRIIVHPQFYIIQTGADIALLELEEPVNISSHIHTVTLPPASETFPPGMPCWVTGWGDVDNNVHLPPPYPLKEVEVPVVENHLCNAEYHTGLHTGHSFQIVRDDMLCAGSENHDSCQGDSGGPLVCKVNGT

SEQ ID NO: 795736 - protein, 76 aa, Homo sapiens
AFLTGAAIMAVGITLSHLSAFLSSLQGTLKSRVPSQGQHGAVAFYSACCGKKMAAPFVPIIAESGALAGAPWARPS

SEQ ID NO: 795737 - protein, 68 aa, Homo sapiens
MGLEEARRKGCHRTLGKLSRPILDGAASDGCRGSPGSSPSPPPQQQRRLRAGVGAPWAPQTLRSRRRP

SEQ ID NO: 795738 - protein, 160 aa, Homo sapiens
APVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYLAMTPLIPQSKDENSDDYTTFDDVGSLWTTLSTFVALFILTLLYSGIVTFIKVK

SEQ ID NO: 795739 - protein, 401 aa, Homo sapiens
MVHCAGCERPILDRFLLNVLDRAWHIKCVQCCECKTNLSEKCFSREGKLYCKNDFFRRFGTKCAGCAQGISPSDLVRKARSKVFHLNCFTCMVCNKQLSTGEELYVIDENKFVCKDDYLSSSSLKEGSLNSVSSCTDRSLSPDLQDALQDDPKETDNSTSSDKETANNENEEQNSGTKRRGPRTTIKAKQLETLKAAFAATPKPTRHIREQLAQETGLNMRVIQVWFQNRRSKERRMKQLSALGARRHAFFRSPRRMRPLGGRLDESEMLGSTPYTYYGDYQGDYYAPGSNYDFFAHGPPSQAQSPADSSFLAASGPGSTPLGALEPPLAGPHAADNPRFTDMISHPDTPSPEPGLPGTLHPMPGEVFSGGPSPPFPMSGTSGYSGPLSHPNPELNEAAVW

SEQ ID NO: 795740 - protein, 33 aa, Homo sapiens
MVPAFEKFGVVPPAATFPAFCSQNLFVADENRP

SEQ ID NO: 795741 - protein, 106 aa, Homo sapiens
MSSSDESTILHLSHENSIEDLQYVKIDKEENSGTEFGDTDMKYLLYEDEKDFKDYVNLGPLGVKLMSVESKKMPIHFQEKEIPVKLYKDVRSPESHITYKMMKSFL

SEQ ID NO: 795742 - protein, 327 aa, Homo sapiens
GLCSFGVFALLGSLLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEIGPFGGVPLGPMSPAFHPVVQPGKYGGTLWWGRLSPGVAGLTRVRAQGMGRTTGTGLLKREVVVF

SEQ ID NO: 795743 - protein, 146 aa, Homo sapiens
MKADIMERQTQHWEYASGSGEYPQHPQMAKRPGQLCNLPKGLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRC

SEQ ID NO: 795744 - protein, 378 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGFHLPALAVHTTYDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795745 - protein, 2335 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795746 - protein, 2466 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795747 - protein, 2504 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVSEASQVFFLVLPKVAVAFGSTKGSSWWIGVNQPPCPQVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795748 - protein, 2521 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWGGFSSLRGTCHNPLSSSLVCLCDFLWCFPDSHLQEVSSVLGNGRISPHLLLLLPREKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795749 - protein, 2525 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNFESRLGLCELEGHKLRAQRGHTWGCVLGGRGVAVSGCHQLAFEGKFLPRNCCDHVFSVGRGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795750 - protein, 1725 aa, Homo sapiens
MGGIVHEGGPVGKGPGCGFWAAGWRVWLFFMRGITPLLERWLGNLLARQFEGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795751 - protein, 1646 aa, Homo sapiens [sequence omitted]

SEQ ID NO: 795752 - protein, 2578 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNFESRLGLCELEGHKLRAQRGHTWGCVLGGRGVAVSGCHQLAFEGKFLPRNCCDHVFSVGRGRAVFWDIKNRLPRSVTTVQWENSFVSVYSKDNPNLLFNMCGFECRILPKCRTSYEEFTHKDGVWNLQNEVQPGRGWECHERACTSWVSHRSLVGWKDLNGGHSWLLLLWEFLGHVNLDFVVYVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795753 - protein, 1459 aa, Homo sapiens
RLLRSPCYLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795754 - protein, 2466 aa, Homo sapiens; identical to SEQ ID NO: 795746

SEQ ID NO: 795755 - protein, 1343 aa, Homo sapiens
MSSVRIAILDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795756 - protein, 2487 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVSEASQVFFLVLPKVAVAFGSTKGSSWWIGVNQPPVSQEEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNFESRLGLCELEGHKLRAQRGHTWGCVLGGRGVAVSGCHQLAFEGKFLPRNCCDHVFSVGRGRAVFWDIKNRLPRSVTTVQWENSFVSVYSKDNPNLLFNMCGFECRILPKCRTSYEEFTHKDGVWNLQNEVQPGRGWECHERACTSWVSHRSLVGWKDLNGGHSWLLLLWEFLGHVNLDFVVYVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795757 - protein, 1324 aa, Homo sapiens
MAGVKSDEEDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795758 - protein, 2466 aa, Homo sapiens; identical to SEQ ID NO: 795746

SEQ ID NO: 795759 - protein, 2497 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKVMGSDGAWECGKAGAIPVCGWDSALYSSLPKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795760 - protein, 2466 aa, Homo sapiens; identical to SEQ ID NO: 795746

SEQ ID NO: 795761 - protein, 965 aa, Homo sapiens
MPQYRNPFEKGDLYIKLVWVDPVVFQETARTRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795762 - protein, 950 aa, Homo sapiens
MALQPGRKIKRPLLRTRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795763 - protein, 2461 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALDPQSNHPSWCN

SEQ ID NO: 795764 - protein, 2457 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALQGTAARN

SEQ ID NO: 795765 - protein, 823 aa, Homo sapiens
MKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795766 - protein, 2432 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGLQEGEVYSADREDLYA

SEQ ID NO: 795767 - protein, 2410 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRSLLSSSQDPARVT

SEQ ID NO: 795768 - protein, 786 aa, Homo sapiens
MADSVRIPPRRVMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795769 - protein, 769 aa, Homo sapiens
MVGDHQRVNLRLGIWFSPDLLSIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795770 - protein, 652 aa, Homo sapiens
RHSLFPRVKPLCTLSTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795771 - protein, 645 aa, Homo sapiens
SSVQCTPQTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795772 - protein, 609 aa, Homo sapiens
SIAALEIPGKPPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795773 - protein, 665 aa, Homo sapiens
STRSVWAEQKRLGQLAKWKTAEEVAALIRSLPAGGAAQADHCHQEGHAGPTGGALTGLPQYCHQRIGAPTPFPGVSQGGKIREISSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795774 - protein, 574 aa, Homo sapiens
MVEAGGNLAEVSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795775 - protein, 2319 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPKGQICR

SEQ ID NO: 795776 - protein, 538 aa, Homo sapiens
MPLLRAQGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795777 - protein, 500 aa, Homo sapiens
GSFSVGRSSVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795778 - protein, 2276 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQVSKWTQLGHSVCPTHFVPKTQT

SEQ ID NO: 795779 - protein, 2304 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPPRNTGLTSSCAGGTMILTTLSATPGLKFLDIHHRQRLRG

SEQ ID NO: 795780 - protein, 2281 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPWAADAHREYDPSNVKAKADWWTNTAHYNRERIRRGATVDKTVC

SEQ ID NO: 795781 - protein, 2341 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDGAQRWALVTIARLEVILELGWAQPCDVWSIGCILFEYYRGFTLFQTHENREHLVMMEKILGPIPSHMIHRTRKQKYFYKGGLVWDENSSDGRYVKENCKPPEEFMLQDSLEHVQL

SEQ ID NO: 795782 - protein, 2248 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLEVHLLDFPNIVIKGSELQLPFQACLKVEKFGDLILKATEPQMVLFNLYDDWLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDGIQEETIHIPNDQAGDLDMYEI

SEQ ID NO: 795783 - protein, 426 aa, Homo sapiens
GLCSFGVFALLGSLLKTISSYTAFSRLILILRALHVNNDRAKVILKPDKTTITEPHHIWPTLTDEEWIKVEVQLKDLILADYGKKNNVNVASLTQSEIRDIILGMEISAPSQQRQQIAEIEKQTKEQSQLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795784 - protein, 1617 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFSEGFPGFLALQGTEACALPLKSAIVPEFDLTAVGALKWNEAAGCGYSTPVIPALWEAEAGGSRGQEIETILANTVNPVSTKNNKKLAAARVTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795785 - protein, 2043 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQLAKWKTAEEVAALIRSLPVEEQPKQIIVTRKGMLDPLECLYWTSPILSQGPELHPSGVFRGNPGSLNLGPWFLLLGS

SEQ ID NO: 795786 - protein, 358 aa, Homo sapiens
KLPQIVLRQLDSGGGDKRQDYRESCQCGGCIGEVGTPFFEDLAAPVPPAHGAESAALMQRTLTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795787 - protein, 310 aa, Homo sapiens
SLHRAQGGCWKPDVTATQTRTVNKHGDEIITSTTSNYETQTFSSKTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795788 - protein, 1987 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFWEKASGFEESMKWKKLTNAQRSGLNQIPNRRFTLWWSPTINRANVYVGFQVQLDLTGIFMHGKIPTLKISLIQIFRAHLWQKIHESIVMDLCQVFDQELDALEIETVQKETIHPRKSYKMNSSCADILLFASYKWNVSRPSLLADSKDVMDSTTTQKYWIDIQLRWGDYDSHDIERYARAKFLDYTTDNMSIYPSPTGVLIAIDLAYNLHSAYGNWFPGSKPLIQQAMAKIMKANPALYVLRERIRKGLQLYSSEPTEPYLSSQNYGELFSNQIIWFVDDTNVYRVTIHKTFEGNLTTKPINGAIFIFNPRTGQLFLKIIHTSVWAGQKRLGQIGLWENLRKVGPAPGTRTFGL

SEQ ID NO: 795789 - protein, 267 aa, Homo sapiens
RGRGYSDEAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795790 - protein, 274 aa, Homo sapiens
DAWVDPRVRTEWRVRAISAANLHLRTNHIYVSSDDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795791 - protein, 254 aa, Homo sapiens
TRGSTHASGLSGGSDIKETGYTYILPKNVLKKFICISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795792 - protein, 246 aa, Homo sapiens
MTLTTFTETGLLPYYLAHEECLRITSSIHTFGSQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795793 - protein, 227 aa, Homo sapiens
PSFRSFNSISDLRAQIAGYLYGVSPPDNPQVKEIRCIVMVPQWGTHQTVHLPGQLPQHEYLKEMEPLGWIHTQPNESPQLSPQDVTTHAKIMADNPSWDGEKTIIITCSFTPGSCTLTAYKLTPSGYEWGRQNTDKGNNPKGYLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795794 - protein, 1634 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRLTLEDLEDSWDRGIPRINTLFQKDRHTLAYDKGWRVRTDFKQYQVLKQNPFWWTHQRHDGKLWNLNNYRTDMIQALGGVEGILEHTLFKGTYFPTWEGLFW

SEQ ID NO: 795795 - protein, 1545 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKIVNKWNTALIGLMTYFREAVVNTQELLDLLVKCENKIQTRIKIGLNSKMPSRFPPVVFYTPKELGGLGMLSMGHVLIPQSDLRWSKQTDVGITHFRSGMSHEEDQLIPNLYRYIQPWESEFIDSQRVWAEYALKRQEAIAQNRRPDCQTSVEYASS

SEQ ID NO: 795796 - protein, 1448 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVTKERTAQCFLRVDDESMQRFHNRVRQILMASGSTTFTKVQGRHAQLPSCPLLSSAHFTPLSLRPLLAASFSSLLSVPVSMLCAIVAYSMSGHFIVIF

SEQ ID NO: 795797 - protein, 1358 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRAVFWDIKNRLPRSVTTVQWENSFVSVYSKDNPNLLFNMCGFECRILPKCRTSYEEFTHKDGVWNLQNEVQPGRGWE

SEQ ID NO: 795798 - protein, 1319 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDMNHTNSYGIIRGLQFASFIVQYYGLVMDLLVLGLHRASEMAGPPQMPNDFLSFQDIATEAAHPIRLFCRYIDRIHIFFRFTADEARDLIQRYLTEHPDPNNENIVGYNNKKCWPRDARMRLMKHDVNLGRADPGHQTASTGRDYSQGEQSGLGQEGNHLRQRGPGHT

SEQ ID NO: 795799 - protein, 1158 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKEVGIEFMDLYSHLVPVYDVEPLEKITDAYLDQYLWYEADKRRLFPPWIKPADTEPPPLLVYKWCQGINNLQDVWETSEGECNVMLESRFEKMYEKIDLTLLNRLLRLIVDHNIADYMTAKNNVVINYKDAPSCAV

SEQ ID NO: 795800 - protein, 1027 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKSQEPLPDDDEEFELPEFVEPFLKDTPLYTDNTANGIALLWAPRPFNLRSGRTRRALDIPLVKNWYREHCPAGQPVKVRVSYQKLLKYYVLNALKHRPPKAQKKRYLFRSFKATKFFQSTKLDWVEVGLQVCRQGYNMLNLLIHRKNLNYLHLDYNFNLKPVKTLTTKERKKSRFGNAFHLCREVLRLTKLVVDSHVQYRLGNVDAFQLADGLQYIFAHVGQLTGMYRYKYKLMRQIRMCKDLKHLIYYRFNTGPVGKGPGCGFWAAGWRVWLFFMRGITPLLERWLGNLLARQFEGEWFSLCPTSPVIASKVPAPVGVCSLLLYEHSSYWIAFRSSSEMSLTSILFLGLPSGALRGSHAFAGVEIPQKHSCECFKVARLFAYAGHRDALLIPNFINNHNELRSMKVETLIESKESSLESPWDTLLPGRHSKGVAKTVTKQRVESHFDLELRAAVMHDILDMMPEGIKQNKARTILQHLSEAWRCWKANIPWKVPGLPTPIENMILRYVKAKADWWTNTAHYNRERIRRGATVDKTVCKKNLGRLTRLYLKAEQERQHNYLKDGPYITAEEAVAVYTTTVHWLESRRFSPIPFPPLSYKHDTKLLILALERLKEAYSVKSRLNQSQREELGLIEQAYDNPHEALSRIKRHLLTQRAFKVFTE

SEQ ID NO: 795801 - protein, 94 aa, Homo sapiens
EDPPLRCVELLPSHYERVQMLLSDRFLGFFMVPAQSSWNYNFMGVRHDPNMKYELQLANPKEFYHEVHRPSHFLNFALLQEGEVYSADREDLYA

SEQ ID NO: 795802 - protein, 378 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYFYLFDLKAFFTSKALNMAIPGGPKFEPLVRDINLQDEDWNEFNDINKIIIRQPIRTEYKIAFPYLYNNLPHHVHLTWYHTPNVVFIKTEDPDLPAFYFDPLINPISHRHSVKVRKGRDAFPQLF

SEQ ID NO: 795803 - protein, 66 aa, Homo sapiens
HEAGALLTLAVSFSPKVRHDPNMKYELQLANPKEFYHEVHRPSHFLNFALLQEGEVYSADREDLYA

SEQ ID NO: 795804 - protein, 124 aa, Homo sapiens
MEISAPSQQRQQIAEIEKQTKEQSQLTATQTRTVNKHGDEIITSTTSNYETQTFSSKTEWRVRYCRARGWGWKGRLHYLRCWAERCCHSLPVFRAISAANLHLRTNHIYVSSDDIKETGYTYIL

SEQ ID NO: 795805 - protein, 99 aa, Homo sapiens
MDLYSHLVPVYDVEPLEKITDAYLDQYLWYEADKRRLFPPWIKPADTEPPPLLVYKWCQGRTFMRSPCEERGRNLVLRQKSHLGSMIGLLSGCVVVKGS

SEQ ID NO: 795806 - protein, 116 aa, Homo sapiens
MHLTFLASFLSPVKMQVSDVGNILPVVERVTSPSLITHGKTHEPLNIIIENIWRGIERDKIMPPLIMSNFQCTKPYIVQFSSFPFTHGIEESKLSNSANTGNAAEVIEFSAGRQLP

SEQ ID NO: 795807 - protein, 166 aa, Homo sapiens
AAAGRARGAGDMSRRKQSNPRQIKRSLGDMEAREEVQLVGASHMEQKATAPEAPSPPSADVNSPPPLPPPTSPGGPKELEGQEPEPRPTEEEPGSPWSGPDELEPVVQDGQRRIRARLSLATGLSWGPFHGSVQTRASSPRQAEPSPALTLLVLTRLLAEALPSPD

SEQ ID NO: 795808 - protein, 165 aa, Homo sapiens
AAAGRARGAGDMSRRKQSNPRQIKRSLGDMEAREEVQLVGASHMEQKATAPEAPSPPSADVNSPPPLPPPTSPGGPKELEGQEPEPRPTEEEPGSPWSGPGNHAGGGGSSIASRAAWPGPWEQGDVGAGAGVQVAGDPPGPGLCLVQSSANPCSWWYHWSLAPSR

SEQ ID NO: 795809 - protein, 169 aa, Homo sapiens
AAAGRARGAGDMSRRKQSNPRQIKRSLGDMEAREEVQLVGASHMEQKATAPEAPSPPSADVNSPPPLPPPTSPGGPKELEGQEPEPRPTEEEPGSPWSGPDELEPVVQDGQRRIRARLSLATGLSWGPFHGSVQTRASSPRQAEPMRKLRLQDVKSIAQIPRIKQQREK

SEQ ID NO: 795810 - protein, 162 aa, Homo sapiens
AAAGRARGAGDMSRRKQSNPRQIKRSLGDMEAREEVQLVGASHMEQKATAPEAPSPPSADVNSPPPLPPPTSPGGPKELEGQEPEPRPTEEEPGSPWSGPDELEPVVQDGQRRIRARLSLATGLSWGPFHGSVQTRASSPRQAEPRGAISALAPSVQTHRTR

SEQ ID NO: 795811 - protein, 169 aa, Homo sapiens; identical to SEQ ID NO: 795809

SEQ ID NO: 795812 - protein, 128 aa, Homo sapiens
AAAGRARGAGDMSRRKQSNPRQIKRSLGDMEAREEVQLVGASHMEQKATAPEAPSPPSADELEPVVQDGQRRIRARLSLATGLSWGPFHGSVQTRASSPRQAEPMRKLRLQDVKSIAQIPRIKQQREK

SEQ ID NO: 795813 - protein, 109 aa, Homo sapiens
SPLIFGLFKNERWKGGEWGTMKIQKRAYSLPKSGFFSTGANVPLPQDTLELRRKCFEHCALNNLFKKARKCIIHFAVLQKWLMWLILSLSCISLEKAFMWHGLFTNDAK

SEQ ID NO: 795814 - protein, 107 aa, Homo sapiens
LFSYYVSQFYKRKIVVMKEEVLQSWVKGPGQEHGQATGSGHLWNKISLQLKIPNVYCDQQFQYGDQLTCPSNAKKTTAPETASVRRPRVLARFCRRPAVEQASGARG

SEQ ID NO: 795815 - protein, 104 aa, Homo sapiens
EDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQES

SEQ ID NO: 795816 - protein, 494 aa, Homo sapiens
MLASGLLLVTLLACLTVMVLMSVWRQRKSRGKLPPGPTPLPFIGNYLQLNTEQMYNSLMKISERYGPVFTIHLGPRRVVVLCGHDAVKEALVDQAEEFSGRGEQATFDWLFKGYGVAFSNGERAKQLRRFSIATLRGFGVGKRGIEERIQEEAGFLIDALRGTHGANIDPTFFLSRTVSNVISSIVFGDRFDYEDKEFLSLLRMMLGSFQFTATSTGQLYEMFSSVMKHLPGPQQQAFKELQGLEDFIAKKVEHNQRTLDPNSPRDFIDSFLIRMQEEEKNPNTEFYLKNLVMTTLNLFFAGTETVSTTLRYGFLLLMKHPEVEAKVHEEIDRVIGKNRQPKFEDRAKMPYTEAVIHEIQRFGDMLPMGLAHRVNKDTKFRDFFLPKGTEVFPMLGSVLRDPRFFSNPRDFNPQHFLDKKGQFKKSDAFVPFSIGKRYCFGEGLARMELFLFFTTIMQNFRFKSPQSPKDIDVSPKHVGFATIPRNYTMSFLPR

SEQ ID NO: 795817 - protein, 151 aa, Homo sapiens
GCVANAIVEASPDVVDLNIGEMQCCLLLRWLASALLRLLGAATEKRERVKRAETGCCHHTTEGGPGAQPAEGLRDRWEQDPTTRPMEEEVGRSQKGEEKERCLFVHLVFALRKGGELNEKGGRVEKVLSSFRSTVEQCSSWSTNCLDFILA

SEQ ID NO: 795818 - protein, 247 aa, Homo sapiens
QESSGSSIRRGPPGPPPGFQAWHGSGPMGNCAKRPWRRGPKDPLQWLGSPPRGSCPSPSSSPKEQGDPAPGVQGYSVLNSLVGPACIFLRPSIAATQLDRELRPEEIEELQVAFQEFDRDQDGYIGCRELGACMRTLGYMPTEMELIEISQQISGGKVDFEDFVELMGPKLLAETADMIGVRELRDAFREFDTNGDGRISVGELRAALKALLGERLSQREVDEILQDVDLNGDGLVDFEEFVRMMSR

SEQ ID NO: 795819 - protein, 190 aa, Homo sapiens
QESSGSSIRRGPPGPPPGFQAWHGSGPMGNCAKRPWRRGPKDRELRPEEIEELQVAFQEFDRDQDGYIGCRELGACMRTLGYMPTEMELIEISQQISGGKVDFEDFVELMGPKLLAETADMIGVRELRDAFREFDTNGDGRISVGELRAALKALLGERLSQREVDEILQDVDLNGDGLVDFEEFVRMMSR

SEQ ID NO: 795820 - protein, 88 aa, Homo sapiens
HEVDLDTMRETPREPKYSSNKEEWISLAYRPFLDASRSSKLLRAFYVPFLSDQYTVYVNYTILKPRKAKQIRKKSGDRRRAEPTYRKN

SEQ ID NO: 795821 - protein, 77 aa, Homo sapiens
HEVDLDTMRETPREPKYSSNKEEWISLAYRPFLDASRSSKLLRAFYVPFLSDQYTVYVNYTILKPRKAKQIRKKSGG

SEQ ID NO: 795822 - protein, 217 aa, Homo sapiens
ATRLSLSAILVTSAAALATAPTSPVCSPALALPAMATAQPSQVRQKYDTNCDAAINSHITLELYTSYLYLSMAFYFNRDDVALENFFRYFLRLSDDKMEHAQKLMRLQNLRGGHICLHDIRKPECQGWESGLVAMESAFHLEKNVNQSLLDLYQLAVEKGDPQLCHFLESHYLHEQVKTIKELGGYVSNLRKICSPEAGLAEYLFDKLTLGGRVKET

SEQ ID NO: 795823 - protein, 69 aa, Homo sapiens
QLNRISLCPARPGIPHSFIQATIQCLPSQLCVPDTALTIRSEEVSVNKQGRSFGLALEFLGLGGGKKRS

SEQ ID NO: 795824 - protein, 150 aa, Homo sapiens
SLGPGAGRGGVVLKVSPSPCRAGRRVPVRAEGARGRGPRNKVPGAPSGAAVGAARLTAPLLAKAMASKLLRAVILGPPGSGKGTVCQRIAQNFGLQHLSSGHFLRENIKASTEVGEVAKQYIEKSLLVPDHVITRLMMSELENRRGQHWL

SEQ ID NO: 795825 - protein, 86 aa, Homo sapiens
MASKLLRAVILGPPGSGKGTVCQRIAQNFGLQHLSSGHFLRENIKASTEVGEVAKQYIEKSLLVPDHVITRLMMSELENRRGQHWL

SEQ ID NO: 795826 - protein, 70 aa, Homo sapiens
AFWKMRDHMEQRPMISAEDNFNQFPADPPTDHRCKSELNQDQLRLAQISRTTNPVLSSQTKINFHCYIPL

SEQ ID NO: 795827 - protein, 805 aa, Homo sapiens
PGNPMWTSGRMSNAKNWLGLGMSLYFWGLMDLTTTVLSDTPTPQGELEALLSDKPQSHQRTKRSWVWNQFFVLEEYTGTDPLYVGKLHSDMDRGDGSIKYILSGEGAGIVFTIDDTTGDIHAIQRLDREERAQYTLRAQALDRRTGRPMEPESEFIIKIQDINDNEPKFLDGPYVATVPEMSPVGTSVIQVTATDADDPTYGNSARVVYSILQGQPYFSVDSKTGVIRTALMNMDREAKEYYEVIIQAKDMGGQLGGLAGTTTVNITLSDVNDNPPRFPQKHYQMSVLESAPISSTVGRVFAKDLDEGINAEMKYTIVDGDGADAFDISTDPNFQVGIITVKKPLSFESKKSYTLKVEGANPHLEMRFLNLGPFQDTTTVHISVEDVDEPPVFEPGFYFVEVPEDVAIGTTIQIISAKDPDVTNNSIRYSIDRSSDPGRFFYVDITTGALMTARPLDREEFSWHNITVLAMEMNNPSQVGSVPVTIKVLDVNDNAPEFPRFYEAFVCENAKAGQLIQTVSAVDQDDPRNGQHFYYSLAPEAANNPNFTIRDNQDNTARILTRRSGFRQQEQSVFHLPILIADSGQPVLSSTGTLTIQVCSCDDDGHVMSCSPEAYMLPVSLSRGPLIAILACIFVLLVLVLLILSMRRHRKQPYIIDDEENIHENIVRYDDEGGGEEDTEAFDIAAMWNPREAQAGAGPKTRQDMLPEIESLFRYVPQTCAVNSTVHSYVLAKLYEADMDLWTPPFDSLQTYMFEGDGPVAGSLSSLQSATSDSEQSFDFLTDWGPRFRKLAELYGASEGPAPLW

SEQ ID NO: 795828 - protein, 102 aa, Homo sapiens
MLSTGPEAQRDCTHSPRLPQQPRLFSVGSPKPHLTSMCLMCAQSGMQTKVLRSKASHSTLSILPMLQTGGSPSTAAFTWVWYVPPRDGPCYVFLKFAFVANI

SEQ ID NO: 795829 - protein, 182 aa, Homo sapiens
MSILLPNMAEFDTISELEEEEEEEAATSSSSPSSSSSVSGPDDDEEDEEEEEEEEEEEEEEEEEEEEEAPPPPRVVSEEHLRRYAPDPVLVRGAGHITVFGLSNKFDTEFPSVLTGKVAPEEFKTSIGRVNACLKKALPVNVKWLLCGCLCCCCTLGCSLWPVICLNKRTRRSIQKLIRMGK

SEQ ID NO: 795830 - protein, 119 aa, Homo sapiens
MSILLPNMAEFDTISELEEEEEEEAATSSSSPSSSSSVSGPDDDEEDEEEEEEEEEEEEEEEEEEEEEAPPPPRVVSEEHLRRYAPDPVLVRGAGHITVFGLSNKFDTEFPSVLTGKKF

SEQ ID NO: 795831 - protein, 224 aa, Homo sapiens
MSILLPNMAEFDTISELEEEEEEEAATSSSSPSSSSSVSGPDDDEEDEEEEEEEEEEEEEEEEEEEEEAPPPPRVVSEEHLRRYAPDPVLVRGAGHITVFGLSNKFDTEFPSVLTGKVAPEEFKTSIGRVNACLKKALPVNVKWLLCGCLCCCCTLGCSLWPVICLNKRTRRSIQKLIEWENNRLYHKLALHWKLTKRKCETSNMMEYVILIEFLPKYPIFRPD

SEQ ID NO: 795832 - protein, 97 aa, Homo sapiens
FTCYHCTHRQKDVEVHKKSHFSVFYPRRESGTVSSYIKINICFSFPSCKCLSLPKISVISAAAMGIMAALACFYQTQAEQGLQLPFETRADGRRRLQ

SEQ ID NO: 795833 - protein, 157 aa, Homo sapiens
MPNQIRRIMAAAKPKHDWTRSYFRAYMILLPFSETFFYLSSVINPLLYTVSSQQFRRVFVQVLCCRLSLQHANHEKRLRVHAHSTTDSARFVQRPLLFASRRQSSARRTEKIFLSTFQSEAEPQSKSQSLSLESLEPNSGAKPANSAAENGFQEHEV

SEQ ID NO: 795834 - protein, 453 aa, Homo sapiens
MASPSLPGSDCSQIIDHSHVPEFEVATWIKITLILVYLIIFVMGLLGNSATIRVTQVLQKKGYLQKEVTDHMVSLACSDILVFLIGMPMEFYSIIWNPLTTSSYTLSCKLHTFLFEACSYATLLHVLTLSFERYIAICHPFRYKAVSGPCQVKLLIGFVWVTSALVALPLLFAMGTEYPLVNVPSHRGLTCNRSSTRHHEQPETSNMSICTNLSSRWTVFQSSIFGAFVVYLVVLLSVAFMCWNMMQVLMKSQKGSLAGGTRPPQLRKSESEESRTARRQTIIFLRLIVVTLAVCWMPNQIRRIMAAAKPKHDWTRSYFRAYMILLPFSETFFYLSSVINPLLYTVSSQQFRRVFVQVLCCRLSLQHANHEKRLRVHAHSTTDSARFVQRPLLFASRRQSSARRTEKIFLSTFQSEAEPQSKSQSLSLESLEPNSGAKPANSAAENGFQEHEV

SEQ ID NO: 795835 - protein, 100 aa, Homo sapiens
LEEQCRRGWHLLQLQQCAEKRANLRNRMVVRSPGLRAEAELPLFLGLGPLQRGVLQQLMQTEFSFPGEQKDWYPAEAMRQAADDAQDLRYMIPVTQTQRS

SEQ ID NO: 795836 - protein, 86 aa, Homo sapiens
DWTPQSRFCLKTSRDAVGAQGSCLAVRQRANDLPSPKFTDAAARMAPPRRATAFPKLVVSGPLYTHKNEGPKLLLMWVTAIDVTTF

SEQ ID NO: 795837 - protein, 280 aa, Homo sapiens
MLLGNLAIISFICLDSRLHSPMYFFLCNFSLMEMVVTSTVVHRMLADLLSTHKTMSLAKCLTQSFFYFSLGSANFLILMVMAFDRYVAICHPLRYPTITNGPVCVKLVVACWVVGFLSIVSPTLQKTRLWFCGPNIIGHYFCDSAPLLKLACSDTRHIERMDLFLSLLFVLTTMLLIILSYILIVAAVLHIPSSSGCQKAFSTCASHLTVVVLGYGSAIFIYVRPGKGHSTYLNKAVAMVTAMVTPFLNPFIFTFRNEKVKEVIEDVTKRIFLGDPAACR

SEQ ID NO: 795838 - protein, 71 aa, Homo sapiens
SRPKSHELQFKVVSLQLLLSVLQNAGPVFRTHEMSINAIKQYLCVALSKNGVSSVPDVFELSLATLSYSTW

SEQ ID NO: 795839 - protein, 102 aa, Homo sapiens
GSSLSMVACSMAMDAQMGCLPGAYIKALAVANSAWPSRVPTEWPLSDEVLLLAPHIRMLWPVAQEHFSPPAQQISNLKGPGNKAGAGYQLSRVRAPCPGVLS

SEQ ID NO: 795840 - protein, 130 aa, Homo sapiens
MGAPSTSAHPAQGMKHRVQRSVGKSPGRDLRQEGSLEKWRCAWCVALRVCEHALVDLRLDYRASLSEGSVMLSYAIHLNSAAHRLEDLGETLFLADSFPHLQNGGDDIYLLGCVKGKRAHFKNPKALSQG

SEQ ID NO: 795841 - protein, 130 aa, Homo sapiens; identical to SEQ ID NO: 795840

SEQ ID NO: 795842 - protein, 2167 aa, Homo sapiens
SPRGPTMTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKETCARILLYRGADKDVKNNNGQTPFQVAVIAGNFELGELIRNHREQDVVPFQESPKYAARRRGPPGTGLTVPPALLRANSDTSMALPDWMVFSAPGAASSGAPGPTSGSQGQSQPSAPTTKLSSGTLRSASSPRGARARSPSRGRHPEDAKRQPRGRPSSSGTPREGPAGGTGGSGGPGGSLGSRGRRRKLYSAVPGRSFMAVKSYQAQAEGEISLSKGEKIKVLSIGEGGFWEGQVKGRVGWFPSDCLEEVANRSQESKQESRSDKAKRLFRHYTVGSYDSFDAPSLMDGIGPGSDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTYPPEPPYSTPTVPSSSGRLTPSPRGGPFNPGSGGPLPASSPATFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYIQLPPRAASAAMYVPARSGRGRKGPLVKQTKVEGEPQKGGGLPPAPSPSSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASCLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 795843 - protein, 1548 aa, Homo sapiens
MQLMALEQRFGSGLPGGGQPLCLMMSSPLPPPPPHFSCLPASDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTYPPEPPYSTPTVPSSSGRLTPSPRGGPFNPGSGGPLPASSPATFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYIQLPPRAASAAMYVPARSGRGRKGPLVKQTKVEGEPQKGGGLPPAPSPSSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASCLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 795844 - protein, 2182 aa, Homo sapiens
SPRGPTMTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKETCARILLYRGADKDVKNNNGQTPFQVAVIAGNFELGELIRNHREQDVVPFQESPKYAARRRGPPGTGLTVPPALLRANSDTSMALPDWMVFSAPGAASSGAPGPTSGSQGQSQPSAPTTKLSSGTLRSASSPRGARARSPSRGRHPEDAKRQPRGRPSSSGTPREGPAGGTGGSGGPGGSLGSRGRRRKLYSAVPGRSFMAVKSYQAQAEGEISLSKGEKIKVLSIGEGGFWEGQVKGRVGWFPSDCLEEVANRSQESKQESRSDKAKRLFRHYTVGSYDSFDAPSDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTYPPEPPYSTPTVPSSSGRLTPSPRGGPFNPGSGGPLPASSPATFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYIQLPPRAASAAMYVPARSGRGRKGPLVKQTKVEGEPQKGGGLPPAPSPSSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASCLPRKLLPWEEGPGPPPPPLPGPLAQPQASALATVKASIISELSSKLQQFGGSSAAGGALPWARGGSGGGGDSHHGGASYVPERTSSLQRQSIESGEELRLWCHITGLCHFLCVLRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 795845 - protein, 379 aa, Homo sapiens
SPRGPTMTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKVCLAAATPGPSHPR

SEQ ID NO: 795846 - protein, 73 aa, Homo sapiens
SFADSYLDEMVLHMVLSLASHVILSPLEASDTTLGDDCQSVLTAQTSPEHQPICPRCRDSTTQCQGAWLLRVM

SEQ ID NO: 795847 - protein, 151 aa, Homo sapiens
SSCGTTPQPPDVILEPNVTPGNCWAFEGDRGQVTIQLAQKVYLSNLTLQHIPKTISLSGSLDTAPKDFVIYGMEGSPKEEVFLGAFQFQPENIIQMFPLQNQPARAFSAVKVKISSNWGNPGFTCLYRVRVHGSVAPPREQPHQNPYPKRD

SEQ ID NO: 795848 - protein, 99 aa, Homo sapiens
MGECPHLVDVRLGHRSLATGPEQSDICHTGSEARWTTTWYGSLSFSRHKYKMLADLTPGVEMSCRHWARWLTPVIPALWKAEAGGLPELRSSRPAWTTW

SEQ ID NO: 795849 - protein, 150 aa, Homo sapiens
AWHEVATMAVGTQTCGTVRRVRRIEARDVCRGVQTCGTVRRVRRIEARDVCRGVQTCGTVRRVRRIEARDVCRGVQTCGTVRRVRRIEARDVCRGVQTCGTVRRVRRIEARDVCRGVQTCGTVRRVRRIEARDVCRGVQTCGTVRRVRRI

SEQ ID NO: 795850 - protein, 88 aa, Homo sapiens
MLLWASLLAFAPVCGQSGSCSVADWQMPPPYVVLDLPQETLEEETPGANLWPTTITFLTLFLLSLFYSTALTVTSVRGPSGNREGPQY

SEQ ID NO: 795851 - protein, 72 aa, Homo sapiens
CLVGRAADRSRLAMTSPFSLEGECASTWPGATVSSSHATQGLRGYDTWDVPSLLSARAMTADCLKIIMVQYT

SEQ ID NO: 795852 - protein, 112 aa, Homo sapiens
MRKGEVADPAHTTLSSGVGFLARPMGLPLEPFPLWGWGWTHRLPEQAEGEGPKAQTPGPRLDHQPGFAHSAQASVSRPVSPSTPSLRGRATNSTLHLQKSSPGKTETLPTMH

SEQ ID NO: 795853 - protein, 2011 aa, Homo sapiens
SQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLLKSSIGVDKISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 795854 - protein, 978 aa, Homo sapiens
MLENIDSVTFQDFILKHCPSLTSSYSNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLLKSSIGVDKISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 795855 - protein, 1131 aa, Homo sapiens
MLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLRRYRPFARSHSFRFHKEEKLMKICKIKK

SEQ ID NO: 795856 - protein, 372 aa, Homo sapiens
SQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCVSMTS

SEQ ID NO: 795857 - protein, 68 aa, Homo sapiens
IYHPRSRTERRDILQTLQATRGAGRDANNAGGPGRGHESHPVTRSFSTPAMQLRAKPCCSLPHEGAGS

SEQ ID NO: 795858 - protein, 106 aa, Homo sapiens
TSAIVSDMIVVAKWNSPRVDDVVKSMYPPLDPKLLDTGTTTLLLSVSRLVLVTRNACHLTGGLEWIDQSLSAAEEHLEVLREVALAFEPDKGLPGPEGFLQEQSAI

SEQ ID NO: 795859 - protein, 108 aa, Homo sapiens
MFITHGQSSPAEVETPQGRNLHPFCYSPLSHVHARNRAWHIVGSQSLLTESLNPCSPTPSAFDIETKVTEIAHGNLGVAVKIDPSYLVHTSNFILPLFWGLYISLVLA

SEQ ID NO: 795860 - protein, 93 aa, Homo sapiens
EGHNLPQSPDVAVCWQQIESKEERHRMCQGCAAYSPDDHKAFLGQVLPSLVKMGSPSRTLIESSDHQECPTKSLPLLVTRACFPWRAPEGRKL

SEQ ID NO: 795861 - protein, 142 aa, Homo sapiens
MEQQAQKQYFEQWLRRHRLLQEVYPEANAPIGHNRESYMVPFIPLYRNGDFFISSKDLGYDYSYLQDSDPDSFQDYIKSYLEQASRIWSWLLGAAMVGAVLTALLAGLVSLLCRHKRKQLPEEKQPLLMEKEDYHSLYQSHL

SEQ ID NO: 795862 - protein, 215 aa, Homo sapiens
MEDWAGVNRTAFPATPAVNGLEKPALEADIKYTQSASTLSAVGGFLPACAYPASNQHGVYSAPGGGYLAPGPPWPPAQGPPLAPPGAGVAVHGGELAAAMTFKHPSREGSLPAPAARPRTPSVAYTDCPSRPRPPRGSSPRTRARRERQADPGAQVCAAAPAIGTGRIGGLAEEEASAGPRGARPASPQAQPCLWPDPPHFLYWSGFLGFSELGF

SEQ ID NO: 795863 - protein, 501 aa, Homo sapiens
SAPLPTPSQTQAVCPWTPSCLGTHRSPLEVRLGAVPRSAWGPLANPPGVFSPSGSLLSGASAEQTYGEVNQLGGVFVNGRPLPNAIRLRIVELAQLGIRPCDISRQLRVSHGCVSKILARYNETGSILPGAIGGSKPRVTTPNVVKHIRDYKQGDPGIFAWEIRDRLLADGVCDKYNVPSVSSISRILRNKIGSLAQPGPYEASKQPPSQPTLPYNHIYQYPYPSPVSPTGAKMGSHPGVPGTAGHVSIPRSWPSAHSVSNILGIRTFMEQTGALAGSEGTAYSPKMEDWAGVNRTAFPATPAVNGLEKPALEADIKYTQSASTLSAVGGFLPACAYPASNQHGVYSAPGGGYLAPGPPWPPAQGPPLAPPGAGVAVHGGELAAAMTFKHPSREGSLPAPAARPRTPSVAYTDCPSRPRPPRGSSPRTRARRERQADPGAQVCAAAPAIGTGRIGGLAEEEASAGPRGARPASPQAQPCLWPDPPHFLYWSGFLGFSELGF

SEQ ID NO: 795864 - protein, 109 aa, Homo sapiens
ALHQVPHLILDVQEPLVPGLIREGLMVGRCQIETLKNDQDCGQERHSSQKHGVRVGSTYCMAGTVPHTHLLMHTVPCQSYDVGAILILPAFQIRKQALKGQLTYLLSQW

SEQ ID NO: 795865 - protein, 64 aa, Homo sapiens
PEPPMEAEPSPIQQEATVQTPEPPMEVEPSSQQLVPAQHPESPKEVAAQPPVHEMTIPIAGQDQ

SEQ ID NO: 795866 - protein, 271 aa, Homo sapiens
RPPASPDEPSVAASSVGSSRLPLSASLAFSDLTEEMLDCGPSGLVRELEELRSENDYLKDEIEELRAEMLEMRDVYMEEDVYQLQELRQQLDQASKTCRILQYRLRKAERRSLRAAQTGQVDGELIRGLEQDVKVSKDISMRLHKELEVVEKKRARLEEENEELRQRLIETELAKQVLQTELERPREVRTSCIQQGQPRAGGHMQAPPSQCLCEPPLVGNGQLMPPWQGCLFIHSSNMHFLSTYCVNCVLDTKVTMVNKTHPVPVLRELTG

SEQ ID NO: 795867 - protein, 137 aa, Homo sapiens
RPPASPDEPSVAASSVGSSRLPLSASLAFSDLTEEMLDCGPSGLVRELEELRSENDYLKVGGARVEREVAGVAGCHSPAGLRHQPALLPTEQSGERGPSPLGTTLRWIWGSLIPPAPSQLYLGSALLKKTLELATGP

SEQ ID NO: 795868 - protein, 131 aa, Homo sapiens [sequence omitted]

SEQ ID NO: 795869 - protein, 138 aa, Homo sapiens
LFQVNMQIYFLCLRLLRCLFLPCPSLSFPLFYDTCMSPCPSGWGPFDDPVLPALELETGGYKMLSLSPPQGLLPMVPSPWTFFFQFFSWVAAQHSGHVSSNVTSPRRPALITSLPREPVLAQAQPPYLGISLIVQLTF

SEQ ID NO: 795870 - protein, 81 aa, Homo sapiens
LGCWLLWFCYSHYLENAPGRADPHQLRSFLSVGEALLDVGFGVYGDAALLPPASCVCAQTASEAVRVGSCHVLAPPQSRWT

SEQ ID NO: 795871 - protein, 706 aa, Homo sapiens
ATLRLESVDLQSSRNNKEHHTQEMGVKRLTVRRGQPFYLRLSFSRPFQSQNDHITFVAETGPKPSELLGTRATFFLTRVQPGNVWSASDFTIDSNSLQVSLFTPANAVIGHYTLKIEISQGQGHSVTYPLGTFILLFNPWSPEDDVYLPSEILLQEYIMRDYGFVYKGHERFITSWPWNYGQFEEDIIDICFEILNKSLYHLKNPAKDCSQRNDVVYVCRVVSAMINSNDDNGVLQGNWGEDYSKGVSPLEWKGSVAILQQWSARGGQPVKYGQCWVFASVMCTVMRCLGVPTRVVSNFRSAHNVDRNLTIDTYYDRNAEMLSTQKRDKIWNFHVWNECWMIRKDLPPGYNGWQVLDPTPQQTSSGLFCCGPASVKAIREGDVHLAYDTPFVYAEVNADEVIWLLGDGQAQEILAHNTSSIGKEISTKMVGSDQRQSITSSYKYPEGSPEERAVFMKASRKMLGPQRASLPFLDLLESGGLRDQPAQLQLHLARIPEWGQDLQLLLRIQRVPDSTHPRGPIGLVVRFCAQALLHGGGTQKPFWRHTVRMNLDFGKETQWPLLLPYSNYRNKLTDEKLIRVSGIAEVEETGRSMLVLKDICLEPPHLSIEVSERAEVGKALRVHVTLTNTLMVALSSCTMVLEGSGLINGQIAKDLGTLVAGHTLQIQLDLYPTKAGPRQLQVLISSNEVKEIKGYKDIFVTVAGAP

SEQ ID NO: 795872 - protein, 44 aa, Homo sapiens
GRKPRLQGGVIGCMFHLQPREAQKSSSALEVHKKYGDSTGTTLE

SEQ ID NO: 795873 - protein, 211 aa, Homo sapiens
MRGYRVHYYIFTDNPAAVPGVPLGPHRLLSSIPIQGHSHWEETSMRRMETISQHIAKRAHREVDYLFCLDVDMVFRNPWGPETLGDLVAAIHPSYYAVPRQQFPYERRRVSTAFVADSEGDFYYGGAVFGGQVARVYEFTRGCHMAILADKANGIMAAWREESHLNRHFISNKPSKVLSPEYLWDDRKPQPPSLKLIRFSTLDKDISCLRS

SEQ ID NO: 795874 - protein, 67 aa, Homo sapiens
CGRWGQTDHKAVRTRSGPSVSPRTCTEQVPDNIWGGSHEELHTHSVHQTGFPSQTSELTILTEQHAL

SEQ ID NO: 795875 - protein, 165 aa, Homo sapiens
VAQAVTLPGPVLHGLEAGQLLAAHDRVDHLHLVLQGGNAGDDRGRGGRAGPRVGQEWLGRVGGRVLQLSVVLHGVLVHVVIVAAQSLRVLVVVGQLGVHGILEALRQRRVGDLAAHVHADVLLQDHGVGELLLADGAGVLHAQGRLCTVHAEVRLEVALGGEGAA

SEQ ID NO: 795876 - protein, 451 aa, Homo sapiens
AKLRRLVRGPKQALELPSDREVLHPFVRRHALHRNSLEGGHTESNTSLPSGIQASLTSISSLPFEEDEREVALTKLTKSVSAPHISSPEEAAEDADTKQQDGGFAEPSDIAQQEPRFPRIFALNFVVTLEQMLEQTITLVEIVLDADNQQGPGYIDIPKGKGKQFDAQGHCLPDGRTENTPGVETKGLNLKIPRVIALENPRTRSLHRALEETPKGMPKDLNVGQQALSNSGISEVEGLSQHQVPELSCTSAADAINRNSTGQQSQSGSPCIMDDTAFNRGVNAFPEAKHKAGTVCPTVTHSVHSQVLKNQELKAGTSIMGSHLTSAETFTLDSLKAVEVVNLSVSCTATCLPFSSVPKETPARAGFSSKQTLFPITHQPLGSFGVVSTHSSTLDEEVSERMFRGRGRKFGRWNSPGCLCPWPGWEQCRPPAGKDFHRTGAPWRKTGLPNV

SEQ ID NO: 795877 - protein, 491 aa, Homo sapiens
AKLRRLVRGPKQALELPSDREVLHPFVRRHALHRNSLEGGHTESNTSLPSGIQASLTSISSLPFEEDEREVALTKLTKSVSAPHISSPEEAAEDADTKQQDGGFAEPSDIAQQEPRFPRIFALNFVVTLEQMLEQTITLVEIVLDADNQQGPGYIDIPKGKGKQFDAQGHCLPDGRTENTPGVETKGLNLKIPRVIALENPRTRSLHRALEETPKGMPKDLNVGQQALSNSGISEVEGLSQHQVPELSCTSAADAINRNSTGQQSQSGSPCIMDDTAFNRGVNAFPEAKHKAGTVCPTVTHSVHSQVLKNQELKAGTSIMGSHLTSAETFTLDSLKAVEVVNLSVSCTATCLPFSSVPKETPARAGFSSKQTLFPITHQPLGSFGVVSTHSSTLDEEVSERMFSFYQAKEKFKKELKIEGFLYSDLTVLASDIPYFPPEEEEENLEDGIHLVVCVHGLDGNSADLRLVKTFIELGLPGGKLDFLMSEKNQV

SEQ ID NO: 795878 - protein, 95 aa, Homo sapiens
AGPAKTDLLDLRPTSPNPPREKARAKAGRTDPAAAEGLRSLARSRDGELDPRRTPEKRQQDCTENKSSAPSPRAGAQCAGAPLAGRSLCSKREDS

SEQ ID NO: 795879 - protein, 207 aa, Homo sapiens
PREGGGGVKRLRRPAQSARLRVPCETAKMVVGAFPMAKLLYLGIRQVSKPLANRIKEAARRSEFFKTYICLPPAQLYHWVEMRTKMRIMGFRGTVIKPLNEEAAAELGAELLGEATIFIVGGGCLVLEYWRHQAQQRHKEEEQRAAWNALRDEVGHLALALEALQAQVQAAPPQGALEELRTELQEVRAQLCNPGRSASHAVPASKK

SEQ ID NO: 795880 - protein, 109 aa, Homo sapiens [sequence omitted]

SEQ ID NO: 795881 - protein, 208 aa, Homo sapiens
PREGGGGVKRLRRPAQSARLRVPCETAKMVVGAFPMAKLLYLGIRQVSKPLANRIKEAARRSEFFKTYICLPPAQLYHWLEMRTKMRIMGFNAAAIKPLNEGAAAELGAELLGEGIIFITACSCLMLEYWRHQLQQRRKEKERRVAREALRGEVGHLGLALEELQAQVQATSTQLALEELRAQLQEVRAHLCLRDPPPAPPVAPASEK

SEQ ID NO: 795882 - protein, 161 aa, Homo sapiens
MAPSFTARIQLFLLRALGFLIGLVGRAALVLGGPKFASKTPRPVTEPLLLLSGMQLAKLIRQRKVKCIDVVQAYINRIKDVNPMINGIVKYRFEEAMKEAHAVDQKLAEKQEDEATLENKWPFLGVPLTVKEAFQLQGMPNSSGLMNRRDAIAKTDATVVD

SEQ ID NO: 795883 - protein, 110 aa, Homo sapiens
SGNLQSWLKRKGKGKQAHLTWLEEEEESEGGGLHTSKQPDLVRTHYHKNGKVEITPMIQSITSHKAPPPTLGITIRHEIWAGTQMQTTSDGDFMLLWKIHCYLVWNPMKY

SEQ ID NO: 795884 - protein, 107 aa, Homo sapiens
PEAGDGSGRSRWAPGGTEAGRQWVPGPKVTVVAGSGEEGGVQSIRGPVCPAMGFELDRGFSLKIPQKGAVPRLRPVIQCCGRQRRENHMMLGAQDSLGNTGDAVSLK

SEQ ID NO: 795885 - protein, 543 aa, Homo sapiens
MGDWNLLGGILEEVHSHSTIVGKIWLTILFIFRMLVLRVAAEDVWDDEQSAFACNTRQPGCNNICYDDAFPISLIRFWVLQIIFVSSPSLVYMGHALYRLRAFEKDRQRKKSHLRAQMENPDLDLEEQQRIDRELRRLEEQKRIHKVPLKGCLLRTYVLHILTRSVLEVGFMIGQYILYGFQMHPLYKCTQPPCPNAVDCFVSRPTEKTIFMLFMHSIAAISLLLNILEIFHLGIRKIMRTLYKKSSSEGIEDETGPPFHLKKYSVAQQCMICSSLPERISPLQANNQQQVIRVNVPKSKTMWQIPQPRQLEVDPSNGKKDWSEKDQHSGQLHVHSPCPWAGSAGNQHLGQQSDHSSFGLQNTMSQSWLGTTTAPRNCPSFAVGTWEQSQDPEPSGEPLTDLHSHCRDSEGSMRESGVWIDRSRPGSRKASFLSRLLSEKRHLHSDSGSSGSRNSSCLDFPHWENSPSPLPSVTGHRTSMVRQAALPIMELSQELFHSGCFLFPFFLPGVCMYVCVDREADGGGDYLWRDKIIHSIHSVKFNS

SEQ ID NO: 795886 - protein, 157 aa, Homo sapiens
MPGDGSLRLGEVGALCDRASESGLRPVLARAVTRTVSGGRDARRLHQQEETPGGRNLRQIAGDAARDPSLQACADGVRLPKVRKGKKAKGKKVVPTLAVLKKQETVKVVNLPFEKFGTGQDILALDRTSSPKGTSLALSNGPIILGCNSREPSSISS

SEQ ID NO: 795887 - protein, 111 aa, Homo sapiens
GDGPASLGEVTHSERVSFVIRALQFSSAVTVVSKSSNVSADPAQPSPDRVRSPSRLPRRRGAEPGKNPPPEGPRPGLCLREQVLLTQRDARTGSPTPPVTSRPPELKTWPD

SEQ ID NO: 795888 - protein, 49 aa, Homo sapiens [sequence omitted]

SEQ ID NO: 795889 - protein, 98 aa, Homo sapiens
EMTAQGPTASNLNAGSQTKEEAGSSCAWMGEGGGLHRSGSSFWLLPGESAMQCVKGLLVPGSVGCDDIILEVTDWIGNGADAECLARYVLGTGLHNGH

SEQ ID NO: 795890 - protein, 123 aa, Homo sapiens
RLECNGTITAHCSLKLPSSSDPLTSASRVGGSQGVETGSCYVAQAGFELLASSNPPTSASQSNPLTLKPHFPSLKVFLDPPLCCSPLRPSYKWLGAVVHTCNPSTLGGQGARITRSGDRDHPG

SEQ ID NO: 795891 - protein, 112 aa, Homo sapiens [sequence omitted]

SEQ ID NO: 795892 - protein, 112 aa, Homo sapiens
WIPNYYHIQKLTQDKDLNCRPRTLKPLKENTGETLQDISLGKDFMAKASKAQTTNQKTDKWDCFKLTIFCTAKEIINRVKRQPAEWEKIFGKYSFNKEIISRIYKKLNKTQQ

SEQ ID NO: 795893 - protein, 89 aa, Homo sapiens
LLYGSTNSINETSAPWLHHHPKARLVKPSSGGWGFNTDILGGHKHSVHCSQGEPAENQSASERTLAVQLHRSCCLRMNLAHPICPKGVC

SEQ ID NO: 795894 - protein, 128 aa, Homo sapiens
VFLELMESEGPPESESSEFFSQQEEENEEEEAQEPEETGPKNPLLQPALTGDVEGLQKIFEDPENPHHEQAMQLLLEEDIVGRNLLYAACMAGQSDVIRALAKYGVNLNEKTGTHSYIVLQPGVVWKL

SEQ ID NO: 795895 - protein, 126 aa, Homo sapiens
VFLELMESEGPPESESSEFFSQQEEENEEEEAQEPEETGPKNPLLQPALTGDVEGLQKIFEDPENPHHEQAMQLLLEEDIVGRNLLYAACMAGQSDVIRALAKYGVNLNEKTTRGILSFFSHQYYL

SEQ ID NO: 795896 - protein, 126 aa, Homo sapiens
VFLELMESEGPPESESSEFFSQQEEENEEEEAQEPEETGPKNPLLQPALTGDVEGLQKIFEDPENPHHEQAMQLLLEEDIVGRNLLYAACMAGQSDVIRALAKYGVNLNEKTYLKMQCNIFKVRYI

SEQ ID NO: 795897 - protein, 801 aa, Homo sapiens
MEASGKLICRQRQVLFSFLLLGLSLAGAAEPRSYSVVEETEGSSFVTNLAKDLGLEQREFSRRGVRVVSRGNKLHLQLNQETADLLLNEKLDREDLCGHTEPCVLRFQVLLESPFEFFQAELQVIDINDHSPVFLDKQMLVKVSESSPPGTAFPLKNAEDLDIGQNNIENYIISPNSYFRVLTRKRSDGRKYPELVLDNALDREEEAELRLTLTALDGGSPPRSGTAQVYIEVVDVNDNAPEFEQPFYRVQISEDSPISFLVVKVSATDVDTGVNGEISYSLFQASDEISKTFKVDFLTGEIRLKKQLDFEKFQSYEVNIEARDAGGFSGKCTVLIQVIDVNDHAPEVTMSAFTSPIPENAPETVVALFSVSDLDSGENGKISCSIQEDLPFLLKSSVGNFYTLLTETPLDRESRAEYNVTITVTDLGTPRLTTHLNMTVLVSDVNDNAPAFTQTSYTLFVRENNSPALHIGSVSATDRDSGTNAQVTYSLLPPQDPHLPLASLVSINTDNGHLFALRSLDYEALQAFEFRVGASDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKQRLVVLVKDNGEPPCSATATLHLLLVDGFSQPYLPLPEAAPAQGQADSLTVYLVVALASVSSLFLFSVLLFVAVLLCRRSRAASVGRCSVPEGPFPGHLVDVRGTGSLSQNYQYEVCLAGGSGTNEFQFLKPVLPNIQGHSFGPEMEQNSNFRNGFGFSLQLK

SEQ ID NO: 795898 - protein, 86 aa, Homo sapiens
HRGRTQGNEVTALSQTRQGGLAGGMGVGATERGEWALAASSQAQDVRPQATGLPVSAGPPSLGGASQSRRGLPARARPPALPARGQ

SEQ ID NO: 795899 - protein, 381 aa, Homo sapiens
MGPIGAEADENQTVEEMKVEQYGPQTTPRGELVPDPEPELIDSTKLIEVQVVLILAYCSIILLGVIGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYTRIWSKLKNHVSPGAANDHYHQRRQKTTKMLVCVVVVFAVSWLPLHAFQLAVDIDSQVLDLKEYKLIFTVFHIIAMCSTFANPLLYGWMNSNYRKAFLSAFRCEQRLDAIHSEVSVTFKAKKNLEVRKNSGPNDSFTEATNV

SEQ ID NO: 795900 - protein, 381 aa, Homo sapiens; identical to SEQ ID NO: 795899

SEQ ID NO: 795901 - protein, 381 aa, Homo sapiens; identical to SEQ ID NO: 795899

SEQ ID NO: 795902 - protein, 141 aa, Homo sapiens
YAGKQCLPRAQRLMREAGNEQGNSPSPARGQLRTAFSNSPLLLQTQSIHLRLLCKRLPRGMMPGPVHNTGCLSALHKGSLPASSVILRGPQHPQAFDNQALAPTVCQTLASAWLRGGHSRPQLLALEQLLPGSSCKQEPAA

SEQ ID NO: 795903 - protein, 141 aa, Homo sapiens
HSGSGVLILTCCSPPVLQWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 795904 - protein, 460 aa, Homo sapiens
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRRLLRTCVDFFRLVPFMVFLIVPFMEFLLPVFLKLFPEMLPSTFESESKKEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEDEDFIQPPPVTSSPITPSTPISLPKGPITSSEEPTLQAKSQMTAQNSKASSKGA

SEQ ID NO: 795905 - protein, 432 aa, Homo sapiens
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERQKVFLKLFPEMLPSTFESESKKEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEDEDFIQPPPVTSSPITPSTPISLPKGPITSSEEPTLQAKSQMTAQNSKASSKGA

SEQ ID NO: 795906 - protein, 279 aa, Homo sapiens
MVFLIVPFMEFLLPVFLKLFPEMLPSTFESESKKEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEDEDFIQPPPVTSSPITPSTPISLPKGPITSSEEPTLQAKSQMTAQNSKASSKGA

SEQ ID NO: 795907 - protein, 298 aa, Homo sapiens
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRRLLRTCVDFFRLVPFMVFLIVPFMEFLLPVFLKLFPEMLPSTFESESKKEEKQKKKMAVKLELAKFLQETMTEMARRNRAKMGDASTQLSSYVKQVSIFYVMPNNFGAGRSMKNACHHGFPKLFTIFGIANI

SEQ ID NO: 795908 - protein, 491 aa, Homo sapiens
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRRLLRTCVDFFRLVPFMVFLIVPFMEFLLPVFLKLFPEMLPSTFESESKKEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 795909 - protein, 385 aa, Homo sapiens
MKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRKVFLKLFPEMLPSTFESESKKEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEDEDFIQPPPVTSSPITPSTPISLPKGPITSSEEPTLQAKSQMTAQNSKASSKGA

SEQ ID NO: 795910 - protein, 246 aa, Homo sapiens
MEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEDEDFIQPPPVTSSPITPSTPISLPKGPITSSEEPTLQAKSQMTAQNSKASSKGA

SEQ ID NO: 795911 - protein, 591 aa, Homo sapiens
MKKIRTSLKGDLITVTNMGKALFGVQAFLGIEKRTVRNLMNGISVERPLGRNLIPVIGVLKVSVGAQTLLNTKESTLVKNLINVMSVGKPSVRAQILLYIRESIIGEKPYQCRHCSKSFSQRSDLVKHQRIHTGEKPYTCNQCNKHFSQSSDVIKHQRIHTGEKPYKCDVCGKAFSQSSDLILHQRIHTGEKPYPCNQCSKSFSQNSDLIKHRRIHTGEKPYKCNECGKAFNQSSVLILHQRIHTGEKPYPCDQCSKTFSRLSDLINHQRIHTGEKPYPCNQCNKMFSRRSDLVKHHRIHTGEKPYECDECGKTFSQSSNLILHQRIHTGEKPYACSDCTKSFVAVQILLSIKEYTLERNHMHVISVIKVLVKAQTSLNIREYTLVKSLIIAIVVRKPSVRVLTLFFIREFTLEKNYYLCTQCSKSFSQISDLIKHQRIHTGEKPYKCSECRKAFSQCSALTLHQRIHTGKKPNPCDECGKSFSRRSDLINHQKIHTGEKPYKCDACGKAFSTCTDLIEHQKTHAEEKPYQCVQCSRSCSQLSELTIHEEVHCGEDSQNVMNVRKPLVCTPTLFSTRDTVPEKNLMNAVDY

SEQ ID NO: 795912 - protein, 574 aa, Homo sapiens
MGKALFGVQAFLGIEKRTVRNLMNGISVERPLGRNLIPVIGVLKVSVGAQTLLNTKESTLVKNLINVMSVGKPSVRAQILLYIRESIIGEKPYQCRHCSKSFSQRSDLVKHQRIHTGEKPYTCNQCNKHFSQSSDVIKHQRIHTGEKPYKCDVCGKAFSQSSDLILHQRIHTGEKPYPCNQCSKSFSQNSDLIKHRRIHTGEKPYKCNECGKAFNQSSVLILHQRIHTGEKPYPCDQCSKTFSRLSDLINHQRIHTGEKPYPCNQCNKMFSRRSDLVKHHRIHTGEKPYECDECGKTFSQSSNLILHQRIHTGEKPYACSDCTKSFVAVQILLSIKEYTLERNHMHVISVIKVLVKAQTSLNIREYTLVKSLIIAIVVRKPSVRVLTLFFIREFTLEKNYYLCTQCSKSFSQISDLIKHQRIHTGEKPYKCSECRKAFSQCSALTLHQRIHTGKKPNPCDECGKSFSRRSDLINHQKIHTGEKPYKCDACGKAFSTCTDLIEHQKTHAEEKPYQCVQCSRSCSQLSELTIHEEVHCGEDSQNVMNVRKPLVCTPTLFSTRDTVPEKNLMNAVDY

SEQ ID NO: 795913 - protein, 407 aa, Homo sapiens
MSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGNLRAL

SEQ ID NO: 795914 - protein, 529 aa, Homo sapiens
MSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 795915 - protein, 529 aa, Homo sapiens; identical to SEQ ID NO: 795914

SEQ ID NO: 795916 - protein, 549 aa, Homo sapiens
MSARGVVQHALPTPRRGALTMSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 795917 - protein, 33 aa, Homo sapiens
MAFAAEAFCTHHCSFLPSWLFAPAAAAFCGFFP

SEQ ID NO: 795918 - protein, 520 aa, Homo sapiens
MNPDLDTGHNTSAPAHWGELKNANFTGPNQTSSNSTLPQLDITRAISVGLVLGAFILFAIVGNILVILSVACNRHLRTPTNYFIVNLAMADLLLSFTVLPFSAALEVLGYWVLGRIFCDIWAAVDVLCCTASILSLCAISIDRYIGVRYSLQYPTLVTRRKAILALLSVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGHNPRSSIAVKLFKFSREKKAAKTLGIVVGMFILCWLPFFIALPLGSLFSTLKPPDAVFKVVFWLGYFNSCLNPIIYPCSSKEFKRAFVRILGCQCRGRGRRRRRRRRRLGGCAYTYRPWTRGGSLERSQSRKDSLDDSGSCLSGSQRTLPSASPSPGYLGRGAPPPVELCAFPEWKAPGALLSLPAPEPPGRRGRHDSGPLFTFKLLTEPESPGTDGGASNGGCEAAADVANGQPGFKSNMPLAPGQF

SEQ ID NO: 795919 - protein, 197 aa, Homo sapiens
TCIVQEDMPTNPAILAVLDSSGRSSCYHPNGNVWVYINILGGQYSDQAGNRIRAWNWSNSITSSPFVSFKPVFLALNRYIGVRILEQDKISITFLAMGQQARISVGTKVKLPNPEEIPILRYVSGDDLLLLASLIKIRRLFHKLEGCVNFPSSQVWEKLKQPSYLSSLSLKLIALCHSSGIKQDIMKTIRNIINEEI

SEQ ID NO: 795920 - protein, 130 aa, Homo sapiens [sequence omitted]

SEQ ID NO: 795921 - protein, 123 aa, Homo sapiens
CLFDSVMSVRQGEGTIQFLSRVRLTQDLYIASHHTPTNVYMLKYLNRHRFLKLPLSKPFNDKPLHFIPLGLLLATKAGGNQNLNNCIFLQDISLFEIVPWRACPKVGSWRNSWSLSHWLGKPF

SEQ ID NO: 795922 - protein, 87 aa, Homo sapiens
AQTGWKPGPLAACNWFPWEGRSGDELSSSPGAWQSDHGNENCDPVAHLGCCGSVIVWVSVIFGGRNGQRVAAWINHPHLWARLAPCN

SEQ ID NO: 795923 - protein, 219 aa, Homo sapiens
MWIQVWMTVGTEEAPKVFKMAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSLAFTKNGRLATKYHTVPLPPKGRVLIHWMTLCQTQMKLMAIPLVFQIMFGILNGLYHYAVFEETLEKTIHEE

SEQ ID NO: 795924 - protein, 110 aa, Homo sapiens
RHFQECIMEGLCRTRTKPLNYTKLSMIDQRFDGNPTAFLEKIREALVKHTSLSPDSVEGQLILKDKFITQAAPDIKRKLQKQALEPDSSLENLLKLATSVFYNRDREAQE

SEQ ID NO: 795925 - protein, 311 aa, Homo sapiens
MATSNHSSGAEFILAGLTQRPELQLPLFLLFLGIYVVTVVGNLGMIFLIALSSQLYPPVYYFLSHLSFIDLCYSSVITPKMLVNFVPEENIISFLECITQLYFFLIFVIAEGYLLTAMEYDRYVAICRPLLYNIVMSHRVCSIMMAVVYSLGFLWATVHTTRMSVLSFCRSHTVSHYFCDILPLLTLSCSSTHINEILLFIIGGVNTLATTLAVLISYAFIFSSILGIHSTEGQSKAFGTCSSHLLAVGIFFGSITFMYFKPPSSTTMEKEKVSSVFYITIIPMLNPLIYSLRNKDVKNALKKMTRGRQSS

SEQ ID NO: 795926 - protein, 33 aa, Homo sapiens
MREGRRAAGPHAGRGSRTPDALAGRPRPLKSAA

SEQ ID NO: 795927 - protein, 44 aa, Homo sapiens
MGQTGILCSSREHDFFGSHTICSCRSGRAPEWMQAQMFSGLGVK

SEQ ID NO: 795928 - protein, 73 aa, Homo sapiens
MTYFPLGRYPVVGLLDQMVVLSTFSSLKNLHIVFHSGCTSLHSHQLCKRVPFSPHPRQHLLFFDFWIKAILAE

SEQ ID NO: 795929 - protein, 206 aa, Homo sapiens
DAVVIPFVLGSCVFPGVIRPARVVSGEAALSRRLFPNLIRWAPIEDSMDMDMSPLRAQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADED

SEQ ID NO: 795930 - protein, 83 aa, Homo sapiens
VHISGQHLVAVEEDAESEDEEDVQKTTSVHISGQHLVAVEEDAESEDEEEEDVKLLSISGKRSAPGGGSKVPQKKVKLAADED

SEQ ID NO: 795931 - protein, 126 aa, Homo sapiens
NGNLLFHSSGGYQPKIKESPGLVASGSSEGESIPCLSPCFWWLLAILGLRIHHSNLCLRENPVILSVSCVVIWPYKDNQSLDLRPTLIQYDLILIRLYLQRPCFQIRSNSQVLGVRISRYLFEDTI

SEQ ID NO: 795932 - protein, 263 aa, Homo sapiens
AVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKNAEEAQFELGRLMELHGEGSSSGKATGDETGAKVERADGYEPPVQESV

SEQ ID NO: 795933 - protein, 257 aa, Homo sapiens
MLMPKKNRIAIYELLFKEGVMVAKKDVHMPKHPELADKNAPNLRVMKAMQSLKSRGYVKDSLPGDISTGTLPMRVSSISVITFICPRRLCLPPYTAAVQRLAGLGLKVWRVSDLQDSQEGKPTEIPTNGVLCPLVPTRKPRLGPGQQPNSSSEMDLVVDVVSHLSKIGEDYYAMNKLTVKKKKRKKKKNNRLADNTITTRRKSKRGGSTKGVIKRAQEQKRDPHKENRDQREKKRGTPTEEGEKKKKEEKHGDKHQD

SEQ ID NO: 795934 - protein, 101 aa, Homo sapiens
EHRRLAGAVARMRPEVASSHCASAARAQRGPGRGFAARPVVPAGLAVPAVPGARGPGRPGALSPHPSPLAALSGLGSCHIEDTLRPQLYLPPSASSLQSPP

SEQ ID NO: 795935 - protein, 41 aa, Homo sapiens
ICVSGLLLAKRSVCGHLRNPHSTPGAVLHSILISRNETTFL

SEQ ID NO: 795936 - protein, 123 aa, Homo sapiens
ALPAPAEPLQRAINLCKTEWTTSTWLSEKSDGTASNGTAPAKVDLGASRRDMGRDLPGLPAAPALEPESPRHLTSCTPPPEAGYHRPSGFVLEGAGLVWTIQSGSDHHPVRGTAERTCCTDAV

SEQ ID NO: 795937 - protein, 82 aa, Homo sapiens
AASSCSSRPASSPSAPSTQLPALPTVTHRPNDRLSAVMARDDTRRLPCCAPPEDAERSPFLTLLGHKNTRQLKVAKPHLFML

SEQ ID NO: 795938 - protein, 82 aa, Homo sapiens; identical to SEQ ID NO: 795937

SEQ ID NO: 795939 - protein, 71 aa, Homo sapiens
EHEVRSLGGLSSVSMTISLQPHNCVMGCVIFLTRNQLKDADWEAVHATGRQDVPEKIKNIKYSIRTQSVSI

SEQ ID NO: 795940 - protein, 145 aa, Homo sapiens
DGHRPPPPPQRLIRRAWGDLGTSPPPRGDNTFAAPRLPRRPSWCILGSPLADTYGTCSSFLYLGRRISPAALSREGAALLPGLCIASLYPEPGHPPHLSRHFGFSSRDQASLALSPRHNSSNYPSLPARVLGTSEGLSPTALPKS

SEQ ID NO: 795941 - protein, 115 aa, Homo sapiens
MEFLYRIVVGFILIFTFFNIKGQNTKCPMSCYYIVRVLGTLGILTVFWVCPLTIFNPDYFIPISITIVLTLLLGILFLIVYYGSFHPNRSAETKCDEIDGKPVLRECRMRYFLME

SEQ ID NO: 795942 - protein, 90 aa, Homo sapiens
LSEELVRMVKDMKTYFPSWRHSKPYSFYAFNHVLHCVDSMQANSEIFQLKLTTSSTYNYVQLELLDTVDSEHASKNTDTLVAIFYCRLEG

SEQ ID NO: 795943 - protein, 101 aa, Homo sapiens
GCGSFCRRGSGCGYGGYGYGSGFGSYGYGSGFGGYGYGSGFGGYGYGLPPIVQWRIRILWLLLNELLKLEAEEKPPNVFGPVPCFHSKNPFYCLQHQWRDI

SEQ ID NO: 795944 - protein, 314 aa, Homo sapiens
MSWVLTLKDARVRVESLHAGWNRSHPSPELAGAGVHARAPAVGCRQRSGHLHVRLMQRLLERPCQQRLGKKYQLELPPLHERARKPKGSKNCLQRVRDCELSVLTRRSVRGPEDRGALDHMVRMITSLYSPAVALACQTVCPQSSLCVGKRRLAEQEILAAEEILATRRGVGRQAQEADEAEGAEQHKRPCPEAAGSRQGSPRAGLPPAPLPGSWGSVDPAPRKASLLPLQRLLRSSLRPDVVVPRIRLSKAPAPTFQTQRPARKGSTKDSGHLRIPNQPYKVATEEKPEAEEAEKKRQAKVQEKRPPPWKKRT

SEQ ID NO: 795945 - protein, 117 aa, Homo sapiens
ATADMPPRKFLTGNTYGLQEMRREEKAQRGSVRWFPFAITVLQRDSLKQFKSLRGTFIKRFYTYLGATLGTPHRSSRRTLTFKSGIKACSLWQRHSHQPPVVAALQDDSSPIDLSVL

SEQ ID NO: 795946 - protein, 97 aa, Homo sapiens
MIHINLFYVSKLVLAASLLIQEKLDEQLSSSSRPVTGESTIPVPTDEALSVILAVETSTPLQSKRSNLWPKTKMPVQPRCQIAKEWLTLYALGLKTA

SEQ ID NO: 795947 - protein, 332 aa, Homo sapiens
MATIKSELIKNFAEEEAIHHNKISIVGTGSVGVACAISILLKGLSDELVLVDVDEGKLKGETMDLQHGSPFMKMPNIVSSKDYLVTANSNLVIITAGARQKKGETRLDLVQRNVSIFKLMIPNITQYSPHCKLLIVTNPVDILTYVAWKLSGFPKNRVIGSGCNLDSARFRYFIGQRLGIHSESCHGLILGEHGDSSVPVWSGVNIAGVPLKDLNPDIGTDKDPEQWENVHKKVISSGYEMVKMKGYTSWGISLSVADLTESILKNLRRVHPVSTLSKGLYGINEDIFLSVPCILGENGITDLIKVKLTLEEEACLQKSAETLWEIQKELKL

SEQ ID NO: 795948 - protein, 161 aa, Homo sapiens
MATIKSELIKNFAEEEAIHHNKISIVGTGSVGVACAISILLKGLSDELVLVDVDEGKLKGETMDLQHGSPFMKMPNIVSSKDYLVTANSNLVIITAGARQKKGETRLDLVQRNVSIFKLMIPNITQYSPHCKLLIVTNPGQLCCFKFSTFRFGGTLCRFIT

SEQ ID NO: 795949 - protein, 60 aa, Homo sapiens
MERNSESRNTYSQLTFKKDAKIIQWGGQARWLMPVIPALWEAEAGRSPEVRKSRPAWPTW

SEQ ID NO: 795950 - protein, 33 aa, Homo sapiens
MGRRCQGGRHGDARVGVMEMPGWASWRRQGSLE

SEQ ID NO: 795951 - protein, 168 aa, Homo sapiens
MKKFFTVAILAGSVLSTAHGSLLNLKAMVEAVTGRSAILSFVGYGCYCGLGGRGQPKDEVDWCCHAHDCCYQELFDQGCHPYVDHYDHTIENNTEIVCSDLNKTECDKQTCMCDKNMVLCLMNQTYREEYRGFLNVYCQGPTPNCSIYEPPPEEVTCSHQSPAPPAPP

SEQ ID NO: 795952 - protein, 71 aa, Homo sapiens
VFLTLWPELDLLAPSLATHHLSHSPSVFTPITRIKGEALAAILFQPNSFAGTQPDTLLASVKPPANAVSTM

SEQ ID NO: 795953 - protein, 82 aa, Homo sapiens
MSHLRTHVPSMHPIHSPVSYHLHPITPMSHLHTRVPSTYSCPIIDTYIPFTHACPIIHTPVPSTHPRPILASPSRPHTPVPS

SEQ ID NO: 795954 - protein, 313 aa, Homo sapiens
MHLGERPFCCTLCDKTYCDASGLSRHRRVHLGYRPHSCSVCGKSFRDQSELKRHQKIHQNQEPVDGNQECTLRIPGTQAEFQTPIARSQRSIQGLLDVNHAPVARSQEPIFRTEGPMAQNQASVLKNQAPVTRTQAPITGTLCQDARSNSHPVKPSRLNVFCCPHCSLTFSKKSYLSRHQKAHLTEPPNYCFHCSKSFSSFSRLVRHQQTHWKQKSYLCPICDLSFGEKEGLMDHWRGYKGKDLCQSSHHKCRVILGQWLGFSHDVPTMAGEEWKHGGDQSPPRIHTPRRRGLREKACKGDKTKEAVSILKHK

SEQ ID NO: 795955 - protein, 229 aa, Homo sapiens
MHLGERPFCCTLCDKTYCDASGLSRHRRVHLGYRPHSCSVCGKSFRDQSELKRHQKIHQNQEPVDGNQECTLRIPGTQAEFQTPIARSQRSIQGLLDVNHAPVARSQEPIFRTEGPMAQNQASVLKNQAPVTRTQAPITGTLCQDARSNSHPVKPSRLNVFCCPHCSLTFTSLSAHFPGWSDTSRPTGSRRATFALSVTSPLGRKRALWITGGAIKARTCARAATINAG

SEQ ID NO: 795956 - protein, 329 aa, Homo sapiens
MFFKKLSCRFCITLSSLMLLTQRVTSLSLDICEGKVKAASGGFRSRSSLSEHVCKALPYFSYLLFFPALLGGSLCSFQRFQARVQGSSALHPRHSFWALSWRGLQILGLECLNVAVSRVVDAGAGLTDCQQFECIYVVWTTAGLFKLTYYSHWILDDSLLHAAGFGPELGQSPGEEGYVPDADIWTLERTHRISVFSRKWNQSTARWLRRLVFQHSRAWPLLQTFAFSAWWHGLHPGQVFGFVCWAVMVEADYLIHSFANEFIRSWPMRLFYRTLTWAHTQLIIAYIMLAVEVRSLSSLWLLCNSYNSVFPMVYCILLLLLAKRKHKCN

SEQ ID NO: 795957 - protein, 267 aa, Homo sapiens
ALDVLHRHCKGDDVGKAANNPNHCNCIIDQIFTGGLQSDVTCQACHGVSTTIDPCWDISLDLPGSCTSFWPMSPGRESSVNGESHIPGITTLTDCLRRFTRPEHLGSSAKIKCGSCQSYQESTKQLTMNKLPVVACFHFKRFEHSAKQRRKITTYISFPLELDMTPFMASSKESRMNGQLQLPTNSGNNENKYSLFAVVNHQGTLESGHYTSFIRHHKDQWFKCDDAVITKASIKDVLDSEGYLLFYHKQVLEHESEKVKEMNTQAY

SEQ ID NO: 795958 - protein, 78 aa, Homo sapiens
CSFTCHLNTDEYHGCNFSLNLSPELHAHIPAANSLSLLESLQSTSRLNIFNTDIIIFFQACNLNDPSAPSNHTSRNLV

SEQ ID NO: 795959 - protein, 118 aa, Homo sapiens
MTLADDVNLDDLIMTKDDLFGADIKAICTEACLMALREPQNEDVEASDLTKVYTACTWESTAIHSLHCTLSLHKVSHIKPRCEGSVPQRVATGHLTGDNEEPDLNQVQCVFSKLKNVK

SEQ ID NO: 795960 - protein, 118 aa, Homo sapiens; identical to SEQ ID NO: 795959

SEQ ID NO: 795961 - protein, 132 aa, Homo sapiens
MALKFQGKYDQAVHQEAQMPHGQGNSFSRRPTDFSCLGSEEATKICPSTRLSGEMSRLHFHQSLSSSPTPQTTGRLGGSSKFPVADSLVVIMFQKLKWEWKLSSFLYSQKLSPAHSLRKCCILALNTFQQND

SEQ ID NO: 795962 - protein, 105 aa, Homo sapiens
FFEMESHSVAQAGVQWRDLGSLQPSPPRFKRFSCLSLLSSWDYRHAPPHQANFVFLVEMGFLHVGQAGRHRAQPQSSVFKLCSEVVQCRKLPHTKPLKPRERGWV

SEQ ID NO: 795963 - protein, 198 aa, Homo sapiens
IGTARAAADVDRPTRVSDNPLTGLVGGEWSLNFPNRPRFTSCERKCSSDDQSAARSSFNVRPSFTPPSPRFGSCVRAPVSGLRGSVLPGHRRLPGRVGVRRRPASETWQARMLVSVSLGSQYVWTETVHLQGGLGLARTGSGLSAGLVTFRRRVALAGSLDRVSQLHHLFASRPWNSSMLWERERHWGEAGRTLGSWL

SEQ ID NO: 795964 - protein, 130 aa, Homo sapiens
GPWCRGWRSGRPWAADCCLKPTLRREGGRGGDRTDPLGEANPHSQTQERPRQGDPREGQPCVYTPPARTLLRRSHQLLVEWSVGADLTWRIHASHTWSWATAGTRPLGLSLPGGSPATRGAVPGALSGVS

SEQ ID NO: 795965 - protein, 46 aa, Homo sapiens
LQETGVSVPKGYVAKSPDEAYAIAKKLGSKDVVMKAQVLAGGRGKG

SEQ ID NO: 795966 - protein, 116 aa, Homo sapiens
MRAVFSTSCEAVLTSITPPASNAFLGRGGGLQVKLNLEGTQASASAQLGSGREREGINNSLGNSKSQTFLTTFATSEMIQDVRLAKANSNSTERHKVKRKTAPPPQKPCPSSVYTF

SEQ ID NO: 795967 - protein, 152 aa, Homo sapiens
MVMGTHTYSHWPSCCPSKGQDTSEELLRWSTVPVPPLEPARPNRHPESCRASEDGPLNSRAISPWRYELDRDLNRLPQDLYHARCLCPHCVSLQTGSHMDPRGNSELLYHNQTVFYRRPCHGEKGTHKGYCLERRLYRVSLACVCVRPRVMG

SEQ ID NO: 795968 - protein, 674 aa, Homo sapiens
MVVAHPTATATTTPTATVTATVVMTTATMDLRDWLFLCYGLIAFLTEVIDSTTCPSVCRCDNGFIYCNDRGLTSIPADIPDDATTLYLQNNQINNAGIPQDLKTKVNVQVIYLYENDLDEFPINLPRSLRELHLQDNNVRTIARDSLARIPLLEKLHLDDNSVSTVSIEEDAFADSKQLKLLFLSRNHLSSIPSGLPHTLEELRLDDNRISTIPLHAFKGLNSLRRLVLDGNLLANQRIADDTFSRLQNLTELSLVRNSLAAPPLNLPSAHLQKLYLQDNAISHIPYNTLAKMRELERLDLSNNNLTTLPRGLFDDLGNLAQLLLRNNPWFCGCNLMWLRDWVKARAAVVNVRGLMCQGPEKVRGMAIKDITSEMDECFETGPQGGVANAAAKTTASNHASATTPQGSLFTLKAKRPGLRLPDSNIDYPMATGDGAKTLAIHVKALTADSIRITWKATLPASSFRLSWLRLGHSPAVGSITETLVQGDKTEYLLTALEPKSTYIICMVTMETSNAYVADETPVCAKAETADSYGPTTTLNQEQNAGPMASLPLAGIIGGAVALVFLFLVLGAICWYVHQAGELLTRERAYNRGSREKDDYMESGTKKDNSILEIRGPGLQMLPINPYRAKEEYVVHTIFPSNGSSLCKATHTIGYGTTRGYRDGGIPDIDYSYT

SEQ ID NO: 795969 - protein, 104 aa, Homo sapiens
FLKGSKVHLEEGQEGNLRYQVCQSNLLFIPWGIFRIPSFPVSSESQLPKFCQVPETDSQPWLRHITTTTTTTTTTTTTKTQKGCWMKESCSHTPQQHRALIPAM

SEQ ID NO: 795970 - protein, 136 aa, Homo sapiens
GQVGVPKCLTPPWNSPTCPPGKTENPPFTWEPCDGHLPGLGLCRPTQRTERCAEVPALWALLVGLSSAAAGPQPRQWQHGAPDLLPAASCSTPPPFLSVTPWRGSRSHAARSLQTCHLPHWRGSREARPQQSFPIP

SEQ ID NO: 795971 - protein, 112 aa, Homo sapiens
YLRQVEVEETERGELETGGEAVEQPVGEEVQVSGRPEQGQGAAEREGGGEEGGPERCPQETEEEAEALVTQPPLAVQEQPPQLQVGKGEQRGVEQGVQDAQRQLHGARHRGA

SEQ ID NO: 795972 - protein, 105 aa, Homo sapiens
NYLTFSPPIGTKKNSSGSSVVSSGSSLPAPSPSKEPLSCSGGSSPSSGPPGRSQPSYLNTLLCLELVLCIIFVLGCRVGTESINVFLNTVFPGLIRLVGAVITCC

SEQ ID NO: 795973 - protein, 105 aa, Homo sapiens; identical to SEQ ID NO: 795972

SEQ ID NO: 795974 - protein, 117 aa, Homo sapiens
IQRLPGIETQDSLISLLPGPPSRQPDWKRGQERGAGPSPLSAQSGTWPPHLSLLGWNVVTWSHLAARNTGRCSLYFWQQCAQLQVFTRETRWQISGDNQLSPPQQHTDSLSPALWDT

SEQ ID NO: 795975 - protein, 117 aa, Homo sapiens; identical to SEQ ID NO: 795974

SEQ ID NO: 795976 - protein, 70 aa, Homo sapiens
MTIFPVGFSQPLHGPGPVVPGSPEPATSILDTGHLNWGSFPLYGLPVLADINGFERRKDPLGACKTLVRK

SEQ ID NO: 795977 - protein, 590 aa, Homo sapiens
MELENIVANTVLLKAREGGGGKRKGKSKKWKEILKFPHISQCEDLRRTIDRDYCSLCDKQPIGRLLFRQFCETRPGLECYIQFLDSVAEYEVTPDEKLGEKGKEIMTKYLTPKSPVFIAQVGQDLVSQTEEKLLQKPCKELFSACAQSVHEYLRGEPFHEYLDSMFFDRFLQWKWLERQPVTKNTFRQYRVLGKGGFGEVCACQVRATGKMYACKRLEKKRIKKRKGESMALNEKQILEKVNSQFVVNLAYAYETKDALCLVLTIMNGGDLKFHIYNMGNPGFEEERALFYAAEILCGLEDLHRENTVYRDLKPENILLDDYGHIRISDLGLAVKIPEGDLIRGRVGTVGYMAPEVLNNQRYGLSPDYWGLGCLIYEMIEGQSPFRGRKEKVKREEVDRRVLETEEVYSHKFSEEAKSICKMLLTKDAKQRLGCQEEGAAEVKRHPFFRNMNFKRLEAGMLDPPFVPDPRAVYCKDVLDIEQFSTVKGVNLDHTDDDFYSKFSTGSVSIPWQNEMIETECFKELNVFGPNGTLPPDLNRNHPPEPPKKGLLQRLFKRQHQNNSKSSPSSKTSFNHHINSNHVSSNSTGSS

SEQ ID NO: 795978 - protein, 485 aa, Homo sapiens [sequence omitted]

SEQ ID NO: 795979 - protein, 312 aa, Homo sapiens
MELENIVANTVLLKAREGGGGKRKGKSKKWKEILKFPHISQCEDLRRTIDRDYCSLCDKQPIGRLLFRQFCETRPGLECYIQFLDSVAEYEVTPDEKLGEKGKEIMTKYLTPKSPVFIAQVGQDLVSQTEEKLLQKPCKELFSACAQSVHEYLRGEPFHEYLDSMFFDRFLQWKWLERQPVTKNTFRQYRVLGKGGFGEVCACQVRATGKMYACKRLEKKRIKKRKGESMALNEKQILEKVNSQFVVNLAYAYETKDALCLVLTIMNGGDLKFHIYNMGNPGFEEERALFYAAEILCGLEDLHRENTVYRPH

SEQ ID NO: 795980 - protein, 132 aa, Homo sapiens
MCDLALCPWQPRAVYCKDVLDIEQFSTVKGVNLDHTDDDFYSKFSTGSVSIPWQNEMIETECFKELNVFGPNGTLPPDLNRNHPPEPPKKGLLQRLFKRQHQNNSKSSPSSKTSFNHHINSNHVSSNSTGSS

SEQ ID NO: 795981 - protein, 78 aa, Homo sapiens
MADWGPCCPWTDENAESSYALPKGTQQGRVPMRLSQGPTDPAVPLRPHCHIRISDLGLAVKIPEGDLIRGRVGTVGYM

SEQ ID NO: 795982 - protein, 77 aa, Homo sapiens
KREEVDRRVLETEEVYSHKFSEEAKSICKMVSSWWPDATLKLVAPLPGPGPSLSPEQQTELKGQGSEHGGGGCSPPS

SEQ ID NO: 795983 - protein, 224 aa, Homo sapiens; identical to SEQ ID NO: 740637

SEQ ID NO: 795984 - protein, 59 aa, Homo sapiens
MFKGHRFLSATNLIYITFIFFDLVNCSGQVPTVNMLCRGMKPDSVEKIKVFFKSSGWVQ

SEQ ID NO: 795985 - protein, 349 aa, Homo sapiens
MVSPRRRIWAPRRTPAWICPVGPAGPSGANSLVRWTEGTSRATRAPGTAAPPRPLGSRGAEAAEPQEGLSATVSACFQEQQEMNTLQGPVSFKDVAVDFTQEEWWQLDPDEKIAYGDVMLENYSHLVSVGYDYHQAKHHHGVEVKEVEQGEEPWIMEGEFPCQHSPEPAKAIKPIDRKSVHQICSGPVVLSLSTAVKELVENSLDAGATNIDLKLKDYGVDLIEVSDNGCGVEEENFEGLTLSALKHHTCKIQEFADLTEVETFGFQGEALSSLCALSDVTISTCHASVKVGTRLVFDHDGKIIQETPYPPPQRTTVSVKQLFSTLPVRHKEFQRNIKKTCLLPLRLLP

SEQ ID NO: 795986 - protein, 267 aa, Homo sapiens
MNTLQGPVSFKDVAVDFTQEEWWQLDPDEKIAYGDVMLENYSHLVSVGYDYHQAKHHHGVEVKEVEQGEEPWIMEGEFPCQHSPEPAKAIKPIDRKSVHQICSGPVVLSLSTAVKELVENSLDAGATNIDLKLKDYGVDLIEVSDNGCGVEEENFEGLTLSALKHHTCKIQEFADLTEVETFGFQGEALSSLCALSDVTISTCHASVKVGTRLVFDHDGKIIQETPYPPPQRTTVSVKQLFSTLPVRHKEFQRNIKKTCLLPLRLLP

SEQ ID NO: 795987 - protein, 302 aa, Homo sapiens
KPYQCSECGKTFSQKSYLTIHHRTHTGEKPYACDHCEEAFSHKSRLTVHQRTHTGEKPYECNECGKPFINKSNLRLHQRTHTGEKPYECNECGKTFHRKSFLTIHQWTHTGEKPYECNECGKTFRCKSFLTVHQRTHAGEKPYACNECGKTYSHKSYLTVHHRTHTGEKPYECNECGKSFHCKSFLTIHQRTHAGKKPYECNECEKTFINKLNLGIHKITHTGERPYECNECGKTFRQKSNLSTHQGTHTGEKPYVCGKTFHRKSFLTIHQRTHTGKNHMDVMNVEKLFVRNHTLLYIRELT

SEQ ID NO: 795988 - protein, 83 aa, Homo sapiens
ARPPGGDLRRRGAAAVIGGREQLGWLGLVELPWYPSIPNCKIFMKLKKKITSLGNLGRPRLYKKIKKLAECGGVHLWSSYYGG

SEQ ID NO: 795989 - protein, 56 aa, Homo sapiens
MFHCMYIPYFAYSFTFHGHLGCFYLVGTVNHAAINIGVQIYVPASAFNSFAYIPRS

SEQ ID NO: 795990 - protein, 51 aa, Homo sapiens
MKMELGRDVCSSALRIMKATNIKKRSGGRDTVAPQGMNQLGKEKKESLLSS

SEQ ID NO: 795991 - protein, 67 aa, Homo sapiens
MRIHYLLFALLFLFLVPVPGHGGIINTLQKYYCRVRGGRCAVLSCLPKEEQIGKCSTRGRKCCRRKK

SEQ ID NO: 795992 - protein, 569 aa, Homo sapiens
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGSACFAVSCLLIAYGASKPNALSVLIFIALALNGFGGMCMTFTSLTLPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVGLYTSIFGVLQLLCLLTAPVIGYIMDWRLKECEDASEEPEEKDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 795993 - protein, 569 aa, Homo sapiens; identical to SEQ ID NO: 795992

SEQ ID NO: 795994 - protein, 569 aa, Homo sapiens; identical to SEQ ID NO: 795992

SEQ ID NO: 795995 - protein, 569 aa, Homo sapiens; identical to SEQ ID NO: 795992

SEQ ID NO: 795996 - protein, 450 aa, Homo sapiens
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGSACFAVSCLLIAYGASKPNALSVLIFIALALNGFGGMCMTFTSLTLPNMFGDLRSTFIALMIGSYASSAVTFPGIKLIYDAGVSFIVVLVVWAGCSGLVFLNCFFNWPLEPFPGPEDMDYSVKIKFSWLGFDHKITGKQFYKQVTTVGRRLSVGSSMRSAKEQVALQEGHKLCLSTVDLEVKCQPDAAVAPSFMHSVFSPILLLSLVTMCVTQLRLIFYMGAMNNILKFLVSGDQKTVGLYTSIFGVLQLLCLLTAPVIGYIMDWRLKECEDASEEPEEKDANQCVGQGGAPAPSPQPLQKDPRAACQAQGGWDRGREQCTPRSSRSP

SEQ ID NO: 795997 - protein, 123 aa, Homo sapiens
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLLGSYIELPSIHSSCLPEPC

SEQ ID NO: 795998 - protein, 569 aa, Homo sapiens; identical to SEQ ID NO: 795992

SEQ ID NO: 795999 - protein, 569 aa, Homo sapiens; identical to SEQ ID NO: 795992

SEQ ID NO: 796000 - protein, 177 aa, Homo sapiens
IPRQVSARGEDANQGEKKKKKRDRQIQKITNAMRAFAFTNLLLVGFGVTCLIPNLPLQILSFILHTIVRGFIHSAVGGLYAAVYPSTQFGSLTGLQSLISALFALLQQPLFLAMMGPLQGDPLWVNVGLLLLSLLGFCLPLYLICYRRQLERQLQQRQEDDKLFLKINGSSNQEAFV

SEQ ID NO: 796001 - protein, 69 aa, Homo sapiens
PLQLAPVADQVEREAEAQQAEKEQPHVHPQRVSLERTHHGQKQRQLQQRQEDDKLFLKINGSSNQEAFV

SEQ ID NO: 796002 - protein, 128 aa, Homo sapiens
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGRSVWVP

SEQ ID NO: 796003 - protein, 97 aa, Homo sapiens
TLELFTVPLSTDAALTLCHLLSSWVSLESLTLSYNGLGSNIFRLLDSLRALSGQAGCRLRALHLSILGTLGQEVTVVIIIAEEIPSPAPGFLPSLLK

SEQ ID NO: 796004 - protein, 67 aa, Homo sapiens
EIKKFLDLNDNNDKTYQNLWDTAKAVLRGMFIAINTYIKESERAQTDNLRSHLKELQKQEQTTSKPS

SEQ ID NO: 796005 - protein, 69 aa, Homo sapiens [sequence omitted]

SEQ ID NO: 796006 - protein, 130 aa, Homo sapiens
HQLLSSGRTLILEKRQLLPGSTAVRPSNKRNTSSSLGLQLQEPQTRTPLPLDLQLHDPHRGTATSAPSLPSAPQSKTSVAAPAPPWTSSSTTLRLKRQHRPLPKAPAPPPSGLNSGITSCRPSLPPHNPP

SEQ ID NO: 796007 - protein, 96 aa, Homo sapiens
LQPLMPFDYGADESGGSSSSLSIGYSTLQGLRLGCAFQVRRCCYPGNHINVFLIFRAYWYMPADSVKVLLDDKNKQTKNSKGLIWSEWPQLDLGSF

SEQ ID NO: 796008 - protein, 97 aa, Homo sapiens
GVLSGSEAGDGVCCGVLSGSEAGDGVCCGVLSGSEAGDGVCCGVLSGSEAGDGVCCGVLSGSEAGDGVCCGVLSGSEAGDGVCCGVLSGSEAGDGVC

SEQ ID NO: 796009 - protein, 110 aa, Homo sapiens
ETESCTVAQAGDSGVILAHCSLHLSDSSDSPASASQVAGIIGARHPAWLIFVFLVKMGFCNIGQAGLKLLTSTELPPSGFQSVGIRGLSYWARANLETFFSFLVPQFSQM

SEQ ID NO: 796010 - protein, 127 aa, Homo sapiens
PTGVPSPAGLFISPGPSPGHPPANGPQLHPVHPPPGTTHSDPSRLQEGQEAKDPAEASGSSLRDHPCVTSAPSTGLTARPLPCTRPLPCWPGPREANGEQPGGGTPVSAKPPCCLPSGTYKAHFATN

SEQ ID NO: 796011 - protein, 777 aa, Homo sapiens
YRGAVSCRSFHLTRALARAPPGQWTTAAPGSSTAGDHPLGPEPASRGARGQGSSRGLGLESQGPSLRHVCTQHRPHSPAPALHQATALLVRRVGGATSLPPAPSSPPPPGTCRQEAWPWRVSRPLPRCPAHERPMGSSQEEGLRCQPSQPDHDADGHCGPDLEGAERASATPGPPGLLNSHRPADSDDTNAAGPSAALLEGLLLGGGKPSPHSTRPGPFFYIGGSNGATIISSYCKSKGWQRIHDSRRDDYTLKWCEVKSRDSYGSFREGSGSQHQRRAACRGLLGRSTGQVGGVGTEVLRSLHTSPGLCPPGEQLLYQLPNNKLLTTKIGLLSTLRGRARAMSKASKVPGGVQARLEKDAAAPALEDLPWTSPGYLRPQRVLRMEEFFPETYRLDLKHEREAFFTLFDETQIWICKPTASNQGKGIFLLRNQEEVAALQAKTRSMEDDPIHHKTPFRGPQARVVQRYIQNPLLVDGRKFDVRSYLLIACTTPYMIFFGHGYARLTLSLYDPHSSDLGGHLTNQFMQKKSPLYMLLKEHTVWSMEHLNRYISDTFWKARGLAKDWVFTTLKKRMQQIMAHCFLAAKPKLDCKLGYFDLIGCDFLIDDNFKVWLLEMNSNPALHTNCEVLKEVIPGVVIETLDLVLETFRKSLRGQKMLPLLSQRRFVLLHNGEADPRPHLGGSCSLRRWPPLPTRQAKSSGPPMPHAPDQPGARRPAPPPLVPQRPRPPGPDLDSAHDGEPQAPGTEQSGTGNRHPAQEPSPGTAKEEREEPENARP

SEQ ID NO: 796012 - protein, 696 aa, Homo sapiens
LPGCRLLPVFSSHQGPRPGTPRPMDHSCTRFIHRRGPPTRTRAGFKRGKRPRIQQRPRARVSGTIPASRLHPAPASQPGPCPAPGHCPVGPAHERPMGSSQEEGLRCQPSQPDHDADGHCGPDLEGAERASATPGPPGLLNSHRPADSDDTNAAGPSAALLEGLLLGGGKPSPHSTRPGPFFYIGGSNGATIISSYCKSKGWQRIHDSRRDDYTLKWCEVKSRDSYGSFREGEQLLYQLPNNKLLTTKIGLLSTLRGRARAMSKASKVPGGVQARLEKDAAAPALEDLPWTSPGYLRPQRVLRMEEFFPETYRLDLKHEREAFFTLFDETQIWICKPTASNQGKGIFLLRNQEEVAALQAKTRSMEDDPIHHKTPFRGPQARVVQRYIQNPLLVDGRKFDVRSYLLIACTTPYMIFFGHGYARLTLSLYDPHSSDLGGHLTNQFMQKKSPLYMLLKEHTVWSMEHLNRYISDTFWKARGLAKDWVFTTLKKRMQQIMAHCFLAAKPKLDCKLGYFDLIGCDFLIDDNFKVWLLEMNSNPALHTNCEVLKEVIPGVVIETLDLVLETFRKSLRGQKMLPLLSQRRFVLLHNGEADPRPHLGGSCSLRRWPPLPTRQAKSSGPPMPHAPDQPGARRPAPPPLVPQRPRPPGPDLDSAHDGEPQAPGTEQSGTGNRHPAQEPSPGTAKEEREEPENARP

SEQ ID NO: 796013 - protein, 313 aa, Homo sapiens
YRGAVSCRSFHLTRALARAPPGQWTTAAPGSSTAGDHPLGPEPASRGARGQGSSRGLGLESQGPSLRHVCTQHRPHSPAPALHQATALLVRRVGGATSLPPAPSSPPPPGTCRQEAWPWRVSRPLPRCPAHERPMGSSQEEGLRCQPSQPDHDADGHCGPDLEGAERASATPGPPGLLNSHRPADSDDTNAAGPSAALLEGLLLGGGKPSPHSTRPGPFFYIGGSNGATIISSYCKSKGWQRIHDSRRDDYTLKWCEVKSRDSYGSFREGEQLLYQLPNNKLLTTKIGLLSTLRGRARAMSKASKVPGGVQAR

SEQ ID NO: 796014 - protein, 811 aa, Homo sapiens
YRGAVSCRSFHLTRALARAPPGQWTTAAPGSSTAGDHPLGPEPASRGARGQGSSRGLGLESQGPSLRHVCTQHRPHSPAPALHQATALLVRRVGGATSLPPAPSSPPPPGTCRQEAWPWRVSRPLPRCPAHERPMGSSQEEGLRCQPSQPDHDADGHCGPDLEGAERASATPGPPGLLNSHRPADSDDTNAAGPSAALLEGLLLGGGKPSPHSTRPGPFFYIGGSNGATIISSYCKSKGWQRIHDSRRDDYTLKWCEVKSRDSYGSFREGSGSQHQRRAACRGLLGRSTGQVGGVGTEVLRSLHTSPGLCPPGEQLLYQLPNNKLLTTKIGLLSTLRGRARAMSKASKVPGGVQARLEKDAAAPALEDLPWTSPGYLRPQRVLRMEEFFPETYRLDLKHEREAFFTLFDETQIWICKPTASNQGKGIFLLRNQEEVAALQAKTRSMEDDPIHHKTPFRGPQARVVQRYIQNPLLVDGRKFDVRSYLLIACTTPYMIFFGHGYARLTLSLYDPHSSDLGGHLTNQFMQKKSPLYMLLKEHTVWSMEHLNRYISDTFWKARGLAKDWVFTTLKCLTQDRSCTSLLSEFLAVNLEAECTNVWAGVAVQKRMQQIMAHCFLAAKPKLDCKLGYFDLIGCDFLIDDNFKVWLLEMNSNPALHTNCEVLKEVIPGVVIETLDLVLETFRKSLRGQKMLPLLSQRRFVLLHNGEADPRPHLGGSCSLRRWPPLPTRQAKSSGPPMPHAPDQPGARRPAPPPLVPQRPRPPGPDLDSAHDGEPQAPGTEQSGTGNRHPAQEPSPGTAKEEREEPENARP

SEQ ID NO: 796015 - protein, 109 aa, Homo sapiens
VQEFIPTRGSGEPGAHSWRVSHDRRDGRHFLSPRALTPLHTPASPEASGKCLGPSPWTRVLGPVENICLRVQGGLGTKQPEQPVKGSQLWRWAPHGRWGWGCTSSSATF

SEQ ID NO: 796016 - protein, 139 aa, Homo sapiens
MQKLKKSGSLLQLTFRDNADLRKCFLYQLSQKTGLQYFKNVVLVASPQDRYVPFHSARIEMCKTALKDRHTGPVYAEMINNLLGPLVEAKDCTLIRHNVFHALPNTANTLIGRAAHIAVLDSELFLEKFFLVAGLNYFK

SEQ ID NO: 796017 - protein, 309 aa, Homo sapiens
MPSAGLCSCWGGRVLPLLLAYVCYLLLGATIFQLLERQAEAQSRDQFQLEKLRFLENYTCLDQWAMEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGTDPSKHYISVYRSLAAIWILLGLAWLALILPLGPLLLHRCCQLWLLSLRQGCGAKAAPGRRPRRGSTAARGVQVTPQDFPISKKGLGS

SEQ ID NO: 796018 - protein, 113 aa, Homo sapiens
MNVTIRKVLVRCENQGKTTVSEANVASAYPNRIHVIIKHWKHISNLPCSGSMFNKHSSEHGFSSHVFIYIENMLGRHSECPVPLCSYCELALYFHDSNLICAVSGMSVFPSVM

SEQ ID NO: 796019 - protein, 83 aa, Homo sapiens
LALPHRRVLIAVPDRTALSKRGLDLRPGGSGGVSGRINSSGRAAKEGGRAARTNRLKMAEDVLPFYPAAQRAWIGPEDKGTTY

SEQ ID NO: 796020 - protein, 104 aa, Homo sapiens
RGLGDSTDPQETLCLMILCPPEVPGGCTHCNPHPEWGGREEENRRSWGPPWFLPSTPSGIFSSVWCQQGADTIFFQIIKAESLPLGIQGWVVLWGGVVLATARF

SEQ ID NO: 796021 - protein, 91 aa, Homo sapiens
DELSFKAGDELTKMEDEDEQGWCKGRLDNGQVAYTRQIMWRRSSDESGTGQRGGRRRRAQEPQPATWASTPFPARDDGSIALGFMVFLEGR

SEQ ID NO: 796022 - protein, 87 aa, Homo sapiens
VLQAPEPRCSNRKQTAAAGYRVPACLPPGSTLSPANRPSCPRAAFAAHSQSVGLSGPGKGWKGTRLDLGKQKTTPSSPKRPVQSTGL

SEQ ID NO: 796023 - protein, 395 aa, Homo sapiens
VNVLGLLLMVLAPSPLTSKLEEGLRDCLKATEAGRKLCTQDYTVSGRASTQPELSEPVPSAVSTRPLSLLLLGIPNQAHFKECSYESMKPCAHAAHELGKWSASFSRCVTETVLEDVTGQETTRGNWVIQAVSTLTSSKSNNQRSSLVIGIFSHHTIFGSGMLSSYFDLYVIYLGLVRREEKECDALLASRHGMEGFMDSGTQTDAVVVLSLAQAAVLGLVSENELFGATISAEAFYPDLGPELSGAAMGEPEPPGPDVYQLACNGRALEEPAEEEVLEVEAACEKHTRRKTRPPVRLVPKVKFEKVEEEEQEVYEVSVPGDDKDAGPAEAPAEAASGGCDALVQSSAVKMIDLSAFSRKPRTLRHLPRTPRPELNVAPYDPHFPAPARDGFPEP

SEQ ID NO: 796024 - protein, 252 aa, Homo sapiens
RVEAGGGRTAAARAVGSQEPPARPGPARRGPQRRSRARTQGDALLASRHGMEGFMDSGTQTDAVVVLSLAQAAVLGLVSENELFGATISAEAFYPDLGPELSGAAMGEPEPPGPDVYQLACNGRALEEPAEEEVLEVEAACEKHTRRKTRPPVRLVPKVKFEKVEEEEQEVYEVSVPGDDKDAGPAEAPAEAASGGCDALVQSSAVKMIDLSAFSRKPRTLRHLPRTPRPELNVAPYDPHFPAPARDGFPEP

SEQ ID NO: 796025 - protein, 232 aa, Homo sapiens
PNWMELGGVSTSVRSGPSGYRDALLASRHGMEGFMDSGTQTDAVVVLSLAQAAVLGLVSENELFGATISAEAFYPDLGPELSGAAMGEPEPPGPDVYQLACNGRALEEPAEEEVLEVEAACEKHTRRKTRPPVRLVPKVKFEKVEEEEQEVYEVSVPGDDKDAGPAEAPAEAASGGCDALVQSSAVKMIDLSAFSRKPRTLRHLPRTPRPELNVAPYDPHFPAPARDGFPEP

SEQ ID NO: 796026 - protein, 567 aa, Homo sapiens
MGCWILNEGLSTILVLSWLGINFYLFIDTFYWYEEEESFHYTRVILGSTLAWARASALCLNFNCMLILIPVSRNLISFIRGTSICCRGPWRRQLDKNLRFHKLVAYGIAVNATIHIVAHFFNLERYHWSQSEEAQGLLAALSKLGNTPNESYLNPVRTFPTNTTTELLRTIAGVTGLVISLALVLIMTSSTEFIRQASYELFWYTHHVFIVFFLSLAIHGTGRIVRGQTQDSLSLHNITFCRDRYAEWQTVAQCPVPQFSGKEPSAWKWILGPVVLYACERIIRFWRFQQEVVITKVVSHPSGVLELHMKKRGFKMAPGQYILVQCPAISSLEWHPFTLTSAPQEDFFSVHIRAAGDWTAALLEAFGAEGQALQEPWSLPRLAVDGPFGTALTDVFHYPVCVCVAAGIGVTPFAALLKSIWYKCSEAQTPLKLSKVYFYWICRDARAFEWFADLLLSLETRMSEQGKTHFLSYHIFLTGWDENQALHIALHWDENTDVITGLKQKTFYGRPNWNNEFKQIAYNHPSSSIGVFFCGPKALSRTLQKMCHLYSSADPRGVHFYYNKESF

SEQ ID NO: 796027 - protein, 151 aa, Homo sapiens
EEILSENDQLSNQVVVCLLPFMVINNDDTESAEMKIAIYLSKSGICSLHPLLRGWEEALENVIKSTKPGKLIGVANQKMIELLADNINLGDPSSMLKMVEDLISVGEEESFNLKQKVTFHVILSVLVSCCSSLKETHFPFAIRVFSLLQKK

SEQ ID NO: 796028 - protein, 157 aa, Homo sapiens
MSSEQDKSASKEKSKKPVRFLPQLSMVIYQYTIILHSFMIMFVYYFSSLKEKLASKEKFKAPARALPQLSMVSTKPHWQQAAPSFHLSVKQDDESPEPFSVKNEQSHAEYMERFGKKGKLPHQVDDSYVGPSTSKSKGKSPHKERENFRSTLVNVIM

SEQ ID NO: 796029 - protein, 66 aa, Homo sapiens
GDEGRHRGSRPHRAPEAARPPAQGAACRTTPPCPCAKRVTRVPEALAWLPFATPSSWVLPLPGMFY

SEQ ID NO: 796030 - protein, 101 aa, Homo sapiens
ESGGKLTRWLVNSQWEFERRKPDGTRRLGLPHPVDPIVGEPEYCPMRLGMTTGRLQSGVNILQGFKEDKRNKVTPGLYLNYGPWSSYVPHYDSTFMNIKQG

SEQ ID NO: 796031 - protein, 258 aa, Homo sapiens
ARTKQTARKSTGGKAPRKQLATKAARKSAPATGGVKKPHRYRPGTVALREIRRYQKSTELLIRKLPFQRLVREIAQEFKTDLRFQSSAVMALQEAREAYLVGLFEDTNLCAIHAKRVTIMPKDIQLVSRIRGERAKAKSAPAPKKGSKKAVTKVQKKDGEKRKRSRKESYSVYVEEVLKQVHPDTGISSKTMGIMNSFVNDIFERIAGEASRLAHYNKRSTITSREIQTAVRLLLPGELAKHAVSEGTKAVTKYTSSK

SEQ ID NO: 796032 - protein, 327 aa, Homo sapiens
SRLPPRKARPPPSFGSGRIESSGSNAWGCLPPFIRDRDSIVLTASFYSPPPNLQRGGRRDFLASPSIAPVMPSQNYDLPQKKQEKMTKFQEAVTFKDVAVVFSREELRLLDLTQRKLYRDVMVENFKNLVAVGHLPFQPDMVSQLEAEEKLWMMETETQRSSKHQNKMETLQKFALKYLSNQELSCWQIWKQVASELTRCLQGKSSQLLQGDSIQVSENENNIMNPKGDSSIYIENQEFPFWRTQHSCGNTYLSESQIQSRGKQIDVKNNLQIHEDFMKKSPFHEHIKTDTEPKPCKGNEYGKIISDGSNQKLPLGEKPHPCGECGR

SEQ ID NO: 796033 - protein, 73 aa, Homo sapiens
SRLPPRKARPPPSFGSGRIESSGSNAWGCLPPFIRDRDSIVLTASFYSPPPNLQRGGRRDFLASPSIAPGTCS

SEQ ID NO: 796034 - protein, 356 aa, Homo sapiens
MPWPFCRILQETELFPNFYRSFFFLRRIESSGSNAWGCLPPFIRDRDSIVLTASFYSPPPNLQRGGRRDFLASPSIAPVMPSQNYDLPQKKQEKMTKFQEAVTFKDVAVVFSREELRLLDLTQRKLYRDVMVENFKNLVAVGEDRHSLTLNFSSLENLFASGHLPFQPDMVSQLEAEEKLWMMETETQRSSKHQNKMETLQKFALKYLSNQELSCWQIWKQVASELTRCLQGKSSQLLQGDSIQVSENENNIMNPKGDSSIYIENQEFPFWRTQHSCGNTYLSESQIQSRGKQIDVKNNLQIHEDFMKKSPFHEHIKTDTEPKPCKGNEYGKIISDGSNQKLPLGEKPHPCGECGR

SEQ ID NO: 796035 - protein, 72 aa, Homo sapiens
LLSLFPVLPSQDPALPQKEQEKMTKFQEMVTFKDVAVVFTREELGLLDLAQRKLYQDVMLENFRNLLSVGEH

SEQ ID NO: 796036 - protein, 112 aa, Homo sapiens
NGVNLGGGACSEPRSRHCTPAWAKERDSVSKQNKTKQNKTKILATTGPKAGGIGLRVRSSPLHGLPPVWLWIFELSEFVVCVLCTVSLPGCTRACPSGSPTPSEFHTMQHVL

SEQ ID NO: 796037 - protein, 137 aa, Homo sapiens
LTRSVQQCWVAGREFGIICAQQVRNQNSERFSDFSSGHNIQPGYQTLVSDWEHSVVSLKPTFLWGKKTTSANDVGQFCLLTRVPSTRPGAQHIQDACCKNLQDKWKQVAASQSLCCVDGPGNSSVVLLQEQWGNFFV

SEQ ID NO: 796038 - protein, 118 aa, Homo sapiens
LWKSRAFYPLDPSFRELGYFPSTSLCFNSLVAISCLRARCWLTPEGAPAQTHLGFRLLTRDISPPSSHPSHAKTHTHRAPVWLQNLSDPPSLVESSQVKVMSRSVSCQHHSVASQKKK

SEQ ID NO: 796039 - protein, 97 aa, Homo sapiens
RPWWWWWWWQVCSRLHPSGKKQVPGAWTFALRTLCVRWGDSHEDRHLKYPITGTMQERQAGGDCGSSEETLVLAWIREKGGVSGGFLEEVASGLIIE

SEQ ID NO: 796040 - protein, 101 aa, Homo sapiens
CGSTLHYDPSIASCTHSTLALLKNCKKTFTQLPVLSPYCSLHMLVLLPVVFPDLSRVLDMYTSLNTYMFLNECIHRNFRRLPEIPHVYFYLARILLMMVFP

SEQ ID NO: 796041 - protein, 150 aa, Homo sapiens
YSVLLLSWLRSRPVKRVAEKQEEPQRPSPRKHWGFHLTSGRFALGAAGPSPRPGQGQARILVADPSSRPGQEPVRNLGLLCRGRRLQLSAVVRGLCCVHTTGLHRIPPWPRGWTCGSLGGQHLQSNGCPCHSPEFPCRAPPNTSAFTFLS

SEQ ID NO: 796042 - protein, 74 aa, Homo sapiens
MESCGIHETTFNSIMKCDVDIRKDLYANTVLSGGTTMYPGIADRMQKEITALAPSTMKIHTEYRRSGGAMILIV

SEQ ID NO: 796043 - protein, 58 aa, Homo sapiens
MYDSTDVKSPEWTNPYRGEQISGCPELGGGGIGSHSFLGTRFRFGVMKCCRRGREFSS

SEQ ID NO: 796044 - protein, 102 aa, Homo sapiens [sequence omitted]

SEQ ID NO: 796045 - protein, 83 aa, Homo sapiens
PGPGNKGGRAANGSRAAPGRRQSPSAARTFAARARRWQGERRGGVRGGALLGKLSDPDLVSEGILWASTGRLLKSWDPQPPSS

SEQ ID NO: 796046 - protein, 604 aa, Homo sapiens
VLAPKKAEDSAPGKIQYEVHGRSQPEEQGPPQSPASETIRKATGQQLTTNGAQTFGPDHADQLPAGQKESSQVLGVEPGGTVAEPVGPAAMNQLLLQLREELAAVWREKDAARGALSRPVMEGALGTPRAEAAAAAWEKMEARLERVLARLEWAKAGLQVKPEVPSQESREGALKAAPGSIKQDEEKEKRVPGARGEPLGALGGEKALGGLAKGQLEKEMSVLRLSNSNLLEELGELGRERQRLQRELQSLSQRLQREFVPKPEAQVQLQQLRQSVGLLTNELAMEKEATEKLRKLLASQSSGLRGLWDCLPADLVGERSAQSKAAESLEELRACISTLVDRHREAQQVLARLQEENQQLRGSLSPCREPGTSLKAPASPQVAALEQDLGKLEEELRAVQATMSGKSQEIGKLKQLLYQATEEVAELRAREAASLRQHEKTRGSLVAQAQAWGQELKALLEKYNTACREVGRLREAVAEERRRSGDLAAQAAEQERQASEMRGRSEQFEKTAELLKEKMEHLIGACRDKEAKIKELLKKLEQLSEEVLAIRGENARLALQLQDSQKNHEEIISTYRNHLLNAARGYMEHEVYNILLQILSMEEE

SEQ ID NO: 796047 - protein, 85 aa, Homo sapiens
LVTVGFLRDKEAKIKELLKKLEQLSEEVLAIRGENARLALQLQDSQKNHEEIISTYRNHLLNAARGYMEHEVYNILLQILSMEEE

SEQ ID NO: 796048 - protein, 205 aa, Homo sapiens
MSNFLHLKYNEKSVSVTKALTVRFLTKRFIGEYASNFESIYKKHLCLERKQLNLEIYDPCSQTQKAKFSLTSELHWADGFVIVYDISDRSSFAFAKALIYRIREPQTSHCKRAVESAVFLVGNKRDLCHVREVGWEEGQKLALENRCQFCELSAAEQSLEVEMMFIRIIKDILINFKLKEKRRPSGSKSMAKLINNVFGKRRKSV

SEQ ID NO: 796049 - protein, 75 aa, Homo sapiens
FQKIGLTKKQKSKMNDVKLAVLGGEGTGKSALTVRFLTKRFIGEYASNFESIYKKHLCLERKQLNLEIYDPCSQR

SEQ ID NO: 796050 - protein, 216 aa, Homo sapiens
GWYGPEVRDGLGGESDEQGEGSQVWSEIQALTVRFLTKRFIGEYASNFESIYKKHLCLERKQLNLEIYDPCSQTQKAKFSLTSELHWADGFVIVYDISDRSSFAFAKALIYRIREPQTSHCKRAVESAVFLVGNKRDLCHVREVGWEEGQKLALENRCQFCELSAAEQSLEVEMMFIRIIKDILINFKLKEKRRPSGSKSMAKLINNVFGKRRKSV

SEQ ID NO: 796051 - protein, 154 aa, Homo sapiens
GPGAQFEFLVAYWRREPGARGTCQNGEEWGYSSAPRNHGARAAYCVKAQTFVKAIGRYSAFSQTECVEVQGEAIPLVLALFAFVGFMLILVVVPVFVWKMGRLLQYSCCPVVGLPDTLKITNSPQKLISCRREEVDACATAVMSPEELLRAWIS

SEQ ID NO: 796052 - protein, 31 aa, Homo sapiens
MCMFVVLLFSVGKVQNSANKKGHPGQKRSLK

SEQ ID NO: 796053 - protein, 85 aa, Homo sapiens
GGCWQPPRSPGPGQRQAGVSDVPGRTPECGDTAMFWSLPQHSPYQGGPNPPAGAAGALADEWALKEHLSEGARSWGASARPPRLP

SEQ ID NO: 796054 - protein, 573 aa, Homo sapiens
MLGSLGLWALLPTAVEAPPNRRTCVFFEAPGVRGSTKTLGELLDTGTELPRAIRCLYSRCCFGIWNLTQDRAQVEMQGCRDSDEPGCESLHCDPSPRAHPSPGSTLFTCSCGTDFCNANYSHLPPPGSPGTPGSQGPQAAPGESIWMALVLLGLFLLLLLLLGSIILALLQRKNYRVRGEPVPEPRPDSGRDWSVELQELPELCFSQVIREGGHAVVWAGQLQGKLVAIKAFPPRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEAGTQRYMAPELLDKTLDLQDWGMALRRADIYSLALLLWEILSRCPDLRPDSSPPPFQLAYEAELGNTPTSDELWALAVQERRRPYIPSTWRCFATDPDGLRELLEDCWDADPEARLTAECVQQRLAALAHPQESHPFPESCPRGCPPLCPEDCTSIPAPTILPCRPQRSACHFSVQQGPCSRNPQPACTLSPV

SEQ ID NO: 796055 - protein, 269 aa, Homo sapiens
FGSVLSSLHSCLDVTALLQRKNYRVRGEPVPEPRPDSGRDWSVELQELPELCFSQVIREGGHAVVWAGQLQGKLVAIKAFPPRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEAGPEVLAESWRFWLGGGAPQGFPGAGESGHRGGPLGGGPPG

SEQ ID NO: 796056 - protein, 584 aa, Homo sapiens
MLGSLGLWALLPTAVEAPPNRRTCVFFEAPGVRGSTKTLGELLDTGTELPRAIRCLYSRCCFGIWNLTQDRAQVEMQGCRDSDEPGCESLHCDPSPRAHPSPGSTLFTCSCGTDFCNANYSHLPPPGSPGTPGSQGPQAAPGESIWMALVLLGLFLLLLLLLGSIILALLQRKNYRVRGEPVPEPRPDSGRDWSVELQELPELCFSQVPQGGREGLLWALLEVVLGRNPGPVIAQRPTLSTVSSSRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEAGTQRYMAPELLDKTLDLQDWGMALRRADIYSLALLLWEILSRCPDLRPDSSPPPFQLAYEAELGNTPTSDELWALAVQERRRPYIPSTWRCFATDPDGLRELLEDCWDADPEARLTAECVQQRLAALAHPQESHPFPESCPRGCPPLCPEDCTSIPAPTILPCRPQRSACHFSVQQGPCSRNPQPACTLSPV

SEQ ID NO: 796057 - protein, 138 aa, Homo sapiens
STFLHLDTQGCYSGPCPEDSCTPPFEFHACGSPCAGLCATHLSHQLCQDLPPCQPGCYCPKGLLEQAGGCIPPEECNCWHTSAAGAGMTLAPGDRLQLGCKECECRRGELHCTSQGCQGLLPLSEWSEWSPCGPCLPP

SEQ ID NO: 796058 - protein, 111 aa, Homo sapiens
GQQESLDNWFVTIMASINRTIEIMKKHGVSKQHLLEEINKKRESNCLVERSNQVSLLRVQKRHFPDAYQSFTDTTTKEPVPNSGRSSWIKLSLLAHMERKHFPPKNNAIFG

SEQ ID NO: 796059 - protein, 390 aa, Homo sapiens; identical to SEQ ID NO: 794076

SEQ ID NO: 796060 - protein, 268 aa, Homo sapiens
MFRMLNSSFEDDPFFSESILAHRENMRQMIRSFSEPFGRDLLSISDGRGRAHNRRGHNDGEDSLTHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 796061 - protein, 268 aa, Homo sapiens; identical to SEQ ID NO: 796060

SEQ ID NO: 796062 - protein, 194 aa, Homo sapiens
MDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 796063 - protein, 260 aa, Homo sapiens
MFRMLNSSFEDDPFFSESILAHRENMRQMIRSFSEPFGRDLLSISDGRGRAHNRRGHNDGEDSLTATSCSLVPFGDFGGMHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNERCPCFGARSGTGRFEVNQGNHFDTSHGKFGLEIWSQIKKGNSAPSWGHFGHPQARS

SEQ ID NO: 796064 - protein, 180 aa, Homo sapiens
MRQMIRSFSEPFGRDLLSISDGRGRAHNRRGHNDGEDSLTATSCSLVPFGDFGGMHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVTGSHLWREPA

SEQ ID NO: 796065 - protein, 67 aa, Homo sapiens
MSNGKAARCHAPPIPAGTACAAASEASSVLEASSCRGRGELTSFFQSVRGCRHPRQSQNVQDAEQQF

SEQ ID NO: 796066 - protein, 243 aa, Homo sapiens
MRQMIRSFSEPFGRDLLSISDGRGRAHNRRGHNDGEDSLTHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 796067 - protein, 268 aa, Homo sapiens; identical to SEQ ID NO: 796060

SEQ ID NO: 796068 - protein, 243 aa, Homo sapiens; identical to SEQ ID NO: 796066

SEQ ID NO: 796069 - protein, 243 aa, Homo sapiens; identical to SEQ ID NO: 796066

SEQ ID NO: 796070 - protein, 283 aa, Homo sapiens
MFRMLNSSFEDDPFFSESILAHRENMRQMIRSFSEPFGRDLLSISDGRGRAHNRRGHNDGEDSLTATSCSLVPFGDFGGMHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 796071 - protein, 223 aa, Homo sapiens
MTPSSRELREPGVRGRAGIKHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 796072 - protein, 194 aa, Homo sapiens; identical to SEQ ID NO: 796062

SEQ ID NO: 796073 - protein, 258 aa, Homo sapiens
MRQMIRSFSEPFGRDLLSISDGRGRAHNRRGHNDGEDSLTATSCSLVPFGDFGGMHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 796074 - protein, 258 aa, Homo sapiens; identical to SEQ ID NO: 796073

SEQ ID NO: 796075 - protein, 173 aa, Homo sapiens
GVDFLQVVYILFQMEELVIANNISIDIVDMKEKRKEEMEVFAVFIQLMPIIVLILVSLLSQLMVCNPPYSFYPRSGTGQTIKTQTENLGGVYYVSKDFKNEYKGMLLQKAEKSVEEDYVTNIRNNCWKERQQKTDMQYAAKVYRGDRLRRKSDALSMDNCKELERLTGLYKGG

SEQ ID NO: 796076 - protein, 127 aa, Homo sapiens
QSEKKLPVSYIVHSACKMKTSNSSRVQVLLQLRLKARLPKHCIRTDPVPWKEHCPWNRAGAGHTVPSPSLQHMPHTHSKPRSRQSRHGARVARAMANGPGHQPELGSVSRLQSKYSHECLLSKMVLL

SEQ ID NO: 796077 - protein, 76 aa, Homo sapiens
SPTLTQAGAQEDCISLQVAREGFPGKQTLESGQGPVTGGRRGWHRRHADHGSILEGAGGRTHGIWKSNEWGERRVD

SEQ ID NO: 796078 - protein, 76 aa, Homo sapiens
RRWGLISYPMQTGTEMKALEDRPEEMLPWTQRHGSQALGSPGLVTCARLALTSNTEHMPHARFLDKTLEGGIRAPC

SEQ ID NO: 796079 - protein, 86 aa, Homo sapiens
QAYTQKNSLREEPEPQPDAQSGSIHTTPNTARDTVRHTVRHTARDTVIKTARETARHTARKTDRDAVPDTPRESARDSAPDSADIA

SEQ ID NO: 796080 - protein, 148 aa, Homo sapiens
MLDSARDVMEGSAMLIQEAKQALIAPGDAERQQRLAQVAKAVSHSLNNCVNCLPGQKDVDVALKSIGESSKKLLVDSLPPSTKPFQEAQSELNQAAADLNQSAGEVVHATRGQSGELAAASGKFSDDFDEFLDAGIEMAGQAQVGVEV

SEQ ID NO: 796081 - protein, 66 aa, Homo sapiens
CGHTKAAKPHFSSRPFGQIEGTQLNFQMALNARSVGAAKTEREEQASRAHLPKPLAISKYSSRSGS

SEQ ID NO: 796082 - protein, 299 aa, Homo sapiens
MPLSGTPAPNKKRKSSKLIMELTGGGQESSGLNLGKKISVPRDVMLEELSLLTNRGSKMFKLRQMRVEKFIYENHPDVFSDSSMDHFQKFLPTVGGQLGTAGQGFSYSKSNGRGGSQAGGSGSAGQYGSDQQHHLGSGSGAGGTGGPAGQAGRGGAAGTAGVGETGSGDQAGGEGKHITVFKTYISPWERAMGVDPQQKMELGIDLLAYGAKAELPKYKSFNRTAMPYGGYEKASKRMTFQMPKFDLGPLLSEPLVLYNQNLSNRPSFNRTPIPWLSSGEPVDYNVDIGIPLDGETEEL

SEQ ID NO: 796083 - protein, 299 aa, Homo sapiens; identical to SEQ ID NO: 796082

SEQ ID NO: 796084 - protein, 257 aa, Homo sapiens
MPLSGTPAPNKKRKSKMFKLRQMRVEKFIYENHPDVFSDSSMDHFQKFLPTVGGQLGTAGQGFSYSKSNGRGGSQAGGSGSAGQYGSDQQHHLGSGSGAGGTGGPAGQAGRGGAAGTAGVGETGSGDQAGGEGKHITVFKTYISPWERAMGVDPQQKMELGIDLLAYGAKAELPKYKSFNRTAMPYGGYEKASKRMTFQMPKFDLGPLLSEPLVLYNQNLSNRPSFNRTPIPWLSSGEPVDYNVDIGIPLDGETEEL

SEQ ID NO: 796085 - protein, 150 aa, Homo sapiens
TGQCKEELWKEEIDETGSGDQAGGEGKHITVFKTYISPWERAMGVDPQQKMELGIDLLAYGAKAELPKYKSFNRTAMPYGGYEKASKRMTFQMPKFDLGPLLSEPLVLYNQNLSNRPSFNRTPIPWLSSGEPVDYNVDIGIPLDGETEEL

SEQ ID NO: 796086 - protein, 366 aa, Homo sapiens
MPLSGTPAPNKKRKSSKLIMELTGGGQESSGLNLGKKISVPRDVMLEELSLLTNRGSKMFKLRQMRVEKFIYENHPDVFSDSSMDHFQKFLPTVGGQLGTAGQGFSYSKSNGRGGSQAGGSGSAGQYGSDQQHHLGSGSGAGGTGGPAGQAGRGGAAGTAGVGETGSGDQAGGEGKHITVFKTYISPWERAMGVDPQQKMELGIDLLAYGAKAELPKYKSFNRTAMPYGGYEKASKRMTFQMPKFDLGPLLSEPLVLYNQNLSNRPSFNRTPIPWLSSGEPVDYNVDIGIPSSRAFGFSPKGPGSRASWKAMPSFSSSSMIQLSSSEELEADKEGRKGHTPLIPPSRALSGCAAGPELAGHSLRPH

SEQ ID NO: 796087 - protein, 283 aa, Homo sapiens
MPLSGTPAPNKKRKSSKLIMELTGGGQESSGLNLGKKISVPRDVMLEELSLLTNRGSKMFKLRQMRVEKFIYENHPDVFSDSSMDHFQKFLPTVGGQLGTAGQGFSYSKSNGRGGSQAGGSGSAGQYGSDQQHHLGSGSGAGGTGGPAGQAGRGGAAGTAGVGETGSGDQAGGEGKHITVFKTYISPWERAMGVDRENSKCTQWDRPQDRLGVNKEFTLLPCFPQWLKALGHLLLSLLLELALLLGCGILVLLVLDTRSFMLLSASVNLTSVLPAHPYEPGPT

SEQ ID NO: 796088 - protein, 75 aa, Homo sapiens
QIRTGTYTISCLAPDIQTTLRDFPGSPVCKQIMGLFTLHNHLNMQTVQCHPPDLLIQNLRSEVQESALLNKSFKN

SEQ ID NO: 796089 - protein, 555 aa, Homo sapiens
TRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQIKFTQCLAELKELLRQEIHKKFHELGQDVDLEGSWSDISLSDIESSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNETNLNRRDKDTPLDPSMATLILPKNKGRMQNKKPGFTVSCSPKRTINSSQEPAPGMKPNWPRSRYPATKRGCAAMAAYPSLHIYTYP

SEQ ID NO: 796090 - protein, 503 aa, Homo sapiens
TRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKSSLFTVVILRSKNAKKEQDELLCGGMGILNSYTMESTFGGSTLGNKRDTHFTIEDLKSLGYHVCDTLLDFCDPDQIKFTQCLAELKELLRQEIHKKFHELGQDVDLEGSWSDISLSDIESSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNETNLNRRDKDTPLDPSMATLILPKNKGRMQNKKPGFTVSCSPKRTINSSQEPAPGMKPNWPRSRYPATKRGCAAMAAYPSLHIYTYP

SEQ ID NO: 796091 - protein, 515 aa, Homo sapiens
TRNIGWRREGNEIKYYKNNTDDGQQPFYCLTWTIQFPYDQDTCFFAHFYPYTYTDLQCYLLSVANNPIQSQFCKLQTLCRSLAGNTVYLLTITNPSQTPQEAAAKKAVVLSARVHPGESNGSWVMKGFLDFILSNSPDAQLLRDIFVFKVLPMLNPDGVIVGNYRCSLAGRDLNRHYKTILKESFPCIWYTRNMIKRLLEEREVLLYCDFHGHSRKNNIFLYGCNNNNRKYWLHERVFPLMLCKNAPDKFSFHSCNFKVQKCKEGTGRVVMWRMGILNSYTMESTFGGSTLGNKRDTHFTIEDLKSLGYHVCDTLLDFCDPDQIKFTQCLAELKELLRQEIHKKFHELGQDVDLEGSWSDISLSDIESSTSGSDSSLSDGLPVHLANIADELTQKKKMFKKKKKKSLQTRKQRNEQYQKKNLMQKLKLTEDTSEKAGFASTLQKQPTFFKNSENSSFLPMKNENPRLNEVVFLFLTLCHTDSLTSRISTSLPQCDKCNSHLRYPNLTVPLGARKH

SEQ ID NO: 796092 - protein, 110 aa, Homo sapiens [sequence omitted]

SEQ ID NO: 796093 - protein, 83 aa, Homo sapiens
MDLKKGTDTGAYLREKGGLQASSFCPIMIQGPNWREMFHGTALVIILDLLTTVPTYKSQVQPYTSFCPPVCDPELLVCTKIRD

SEQ ID NO: 796094 - protein, 192 aa, Homo sapiens
MGERHWSVVGVKLLPQDAFPTGSGRPSDLGEVFVEVFSGVFPCPLDVRSVLARVGYWMVRCAGFLGSCFSSLGLELRLLSFPDLGVVSSFTACPRPSSAAVAPASSLALAHGGSLALGLALLVLLALALALAFALAFRLHTSLAFLAALRRGWRRLRELRGAAGVLQGARVPSSCLARPGFLLGLGTFQTLK

SEQ ID NO: 796095 - protein, 162 aa, Homo sapiens
MESLRGNTAQGPTNEEDYKNEGQLSRQTKCPAQKKSSFENTVVRKVSVTLKEIFTGEEGPESSEFSLSPNLDAQQKIPKGHGSPISRKNSKDNSDLIKHQRLFSQRKPCKCNECEKAFSYQSDLLVHSRIHGGEKPFECNKCGKSFSRSTHLIEHQRTHTGE

SEQ ID NO: 796096 - protein, 162 aa, Homo sapiens; identical to SEQ ID NO: 796095

SEQ ID NO: 796097 - protein, 132 aa, Homo sapiens
IQENVDVASLKPISDSGINFTDAIWSPTCERRTCECHESIEKNKDKTDLPQSVVYQNEEGRWVTDLAYYTSFNSKQNLNVSLSDEMNEDFRSGSEAFDLIAQDEEEFNKEHQFIQEENIDAHNTSVALGDTS

SEQ ID NO: 796098 - protein, 102 aa, Homo sapiens
IQENVDVASLKPISDSGINFTDAIWSPTCERRTCECHESIEKNKDKTDLPQSVVYQNEEGRWVTDLAYYTSFNSKQNLNVSLSDEMNEDFRSGCKYMDKHLL

SEQ ID NO: 796099 - protein, 102 aa, Homo sapiens
CSCSLSYIGRLCVVNVDYCLGNHSISVHGLCLALSHNCNCSSLQRYERNICEIDTEDCKSASCKNGTTSTHLRGYFFRKCVPGFKEFVSVAISSCVFFLGRF

SEQ ID NO: 796100 - protein, 41 aa, Homo sapiens
VFNEKLPSPLEALMAQPGWWLLTRVKIYIQSIWHMCRRPFS

SEQ ID NO: 796101 - protein, 1142 aa, Homo sapiens
MGDKDMPTAGMPSLLQSSSESPQSCPEGEDSQSPLQIPQSSPESDDTLYPLQSPQSRSEGEDSSDPLQRPPEGKDSQSPLQIPQSSPEGDDTQSPLQNSQSSPEGKDSLSPLEISQSPPEGEDVQSPLQNPASSFFSSALLSIFQSSPESIQSPFEGFPQSVLQIPVSAASSSTLVSIFQSSPESTQSPFEGFPQSPLQIPVSRSFSSTLLSIFQSSPERSQRTSEGFAQSPLQIPVSSSSSSTLLSLFQSSPERTQSTFEGFPQSPLQIPVSRSFSSTLLSIFQSSPERTQSTFEGFAQSPLQIPVSSSSSSTLLSLFQSSPERTQSTFEGFPQSLLQIPMTSSFSSTLLSIFQSSPESAQSTFEGFPQSPLQIPGSPSFSSTLLSLFQSSPERTHSTFEGFPQSPLQIPMTSSFSSTLLSILQSSPESAQSAFEGFPQSPLQIPVSSSFSYTLLSLFQSSPERTHSTFEGFPQSPLQIPVSSSSSSSTLLSLFQSSPECTQSTFEGFPQSPLQIPQSPPEGENTHSPLQIVPSLPEWEDSLSPHYFPQSPPQGEDSLSPHYFPQSPPQGEDSLSPHYFPQSPQGEDSLSPHYFPQSPPQGEDSMSPLYFPQSPLQGEEFQSSLQSPVSICSSSTPSSLPQSFPESSQSPPEGPVQSPLHSPQSPPEGMHSQSPLQSPESAPEGEDSLSPLQIPQSPLEGEDSLSSLHFPQSPPEWEDSLSPLHFPQFPPQGEDFQSSLQSPVSICSSSTSLSLPQSFPESPQSPPEGPAQSPLQRPVSSFFSYTLASLLQSSHESPQSPPEGPAQSPLQSPVSSFPSSTSSSLSQSSPVSSFPSSTSSSLSKSSPESPLQSPVISFSSSTSLSPFSEESSSPVDEYTSSSDTLLESDSLTDSESLIESEPLFTYTLDEKVDELARFLLLKYQVKQPITKAEMLTNVISRYTGYFPVIFRKAREFIEILFGISLREVDPDDSYVFVNTLDLTSEGCLSDEQGMSQNRLLILILSIIFIKGTYASEEVIWDVLSGIGVRAGREHFAFGEPRELLTKVWVQEHYLEYREVPNSSPPRYEFLWGPRAHSEVIKRKVVEFLAMLKNTVPITFPSSYKDALKDVEERAQAIIDTTDDSTATESASSSVMSPSFSSE

SEQ ID NO: 796102 - protein, 1082 aa, Homo sapiens
MGDKDMPTAGMPSLLQSSSESPQSCPEGEDSQSPLQIPQSSPESDDTLYPLQSPQSRSEGEDSSDPLQRPPEGKDSQSPLQIPQSSPEGDDTQSPLQNSQSSPEGKDSLSPLEISQSPPEGEDVQSPLQNPASSFFSSALLSIFQSSPESIQSPFEGFPQSVLQIPVSAASSSTLVSIFQSSPESTQSPFEGFPQSPLQIPVSRSFSSTLLSIFQSSPERSQRTSEGFAQSPLQIPVSSSSSSTLLSLFQSSPERTQSTFEGFPQSPLQIPVSRSFSSTLLSIFQSSPERTQSTFEGFAQSPLQIPVSSSSSSTLLSLFQSSPERTQSTFEGFPQSLLQIPMTSSFSSTLLSIFQSSPESAQSTFEGFPQSPLQIPGSPSFSSTLLSLFQSSPERTHSTFEGFPQSPLQIPMTSSFSSTLLSILQSSPESAQSAFEGFPQSPLQIPVSSSFSYTLLSLFQSSPERTHSTFEGFPQSPLQIPVSSSSSSSTLLSLFQSSPECTQSTFEGFPQSPLQIPQSPPEGENTHSPLQIVPSLPEWEDSLSPHYFPQSPPQGEDSLSPHYFPQSPPQGEDSLSPHYFPQSFPESSQSPPEGPVQSPLHSPQSPPEGMHSQSPLQSPESAPEGEDSLSPLQIPQSPLEGEDSLSSLHFPQSPPEWEDSLSPLHFPQFPPQGEDFQSSLQSPVSICSSSTSLSLPQSFPESPQSPPEGPAQSPLQRPVSSFFSYTLASLLQSSHESPQSPPEGPAQSPLQSPVSSFPSSTSSSLSQSSPVSSFPSSTSSSLSKSSPESPLQSPVISFSSSTSLSPFSEESSSPVDEYTSSSDTLLESDSLTDSESLIESEPLFTYTLDEKVDELARFLLLKYQVKQPITKAEMLTNVISRYTGYFPVIFRKAREFIEILFGISLREVDPDDSYVFVNTLDLTSEGCLSDEQGMSQNRLLILILSIIFIKGTYASEEVIWDVLSGIGVRAGREHFAFGEPRELLTKVWVQEHYLEYREVPNSSPPRYEFLWGPRAHSEVIKRKVVEFLAMLKNTVPITFPSSYKDALKDVEERAQAIIDTTDDSTATESASSSVMSPSFSSE

SEQ ID NO: 796103 - protein, 1008 aa, Homo sapiens
MGDKDMPTAGMPSLLQSSSESPQSCPEGEDSQSPLQIPQSSPESDDTLYPLQSPQSRSEGEDSSDPLQRPPEGKDSQSPLQIPQSSPEGDDTQSPLQNSQSSPEGKDSLSPLEISQSPPEGEDVQSPLQNPASSFFSSALLSIFQSSPESIQSPFEGFPQSVLQIPVSAASSSTLVSIFQSSPESTQSPFEGFPQSPLQIPVSRSFSSTLLSIFQSSPERSQRTSEGFAQSPLQIPVSSSSSSTLLSLFQSSPERTQSTFEGFPQSPLQIPVSRSFSSTLLSIFQSSPERTQSTFEGFAQSPLQIPVSSSSSSTLLSLFQSSPERTQSTFEGFPQSLLQIPMTSSFSSTLLSIFQSSPESAQSTFEGFPQSPLQIPGSPSFSSTLLSLFQSSPERTHSTFEGFPQSPLQIPMTSSFSSTLLSILQSSPESAQSAFEGFPQSPLQIPVSSSFSYTLLSLFQSSPERTHSTFEGFPQSPLQIPVSSSSSSSTLLSLFQSSPECTQSTFEGFPQSPLQIPQSPPEGENTHSPLQIVPSLPEWEDSLSPHYFPQSPPQGEDSLSPHYFPQSPPQGEDSLSPHYFPQSFPESSQSPPEGPVQSPLHSPQSPPEGMHSQSPLQSPESAPEGEDSLSPLQIPQSPLEGEDSLSSLHFPQSPPEWEDSLSPLHFPQFPPQGEDFQSSLQSPVSICSSSTSLSLPQSFPESPQSPPEGPAQSPLQRPVSSFFSYTLASLLQSSHESPQSPPEGPAQSPLQSPVSSFPSSTSSSLSQSSPVRTQSDFEGFPQSLLQIPMTSSFSSTLLSIFQSSPESAQKYFEGFPQSPLQIPGSPSVSPPALLSLFQSSPEENSQYFEGFPQSPLQIPMTSSFSSTLLSISQSSPESAQSAFEGFPPVSSPDSCELLFLLHFIEVFSRAALKELTSNLEGLPKSLFQILEFSSVYDNYRAFKKSLSVSKEFGGSQVPSKSKPEAHASSSQPEFRGAGHNLSLGGHHHISHGDVSIRRGRSHQSGITR

SEQ ID NO: 796104 - protein, 105 aa, Homo sapiens
MTCPPEWNLGRVRVRALVPGALSWSLLIARTLLTLVLNPTGTNHFYCQSILGLCSSGNKSFFQSSLFNLVRACVCGGGAYINAVFLTCLARFRLALNEYLENKGL

SEQ ID NO: 796105 - protein, 623 aa, Homo sapiens
AQPGGSTSEGSPALGFPYTLAFGSFDHSKPHSVFQRTSPADPEVVGETLPLFLLEPVGSCCLATTMSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPSSPFQVTTGYQLPVYNYQAFPAYPNSAVQVTTGYQFHVYNYQMPPQCPVGEQRRNLWTEAYKWWYLVCLIQRRD

SEQ ID NO: 796106 - protein, 108 aa, Homo sapiens
MRHEDPAQGIPWGFKGNTPVLRVCPVPSGWGGLPALGSMARLARRGQVVSCGTSILLPSRLCHLIFLRSGWFLAKMYLQGPPSIGFGRQERHRRPGKQLHSDNAFSIT

SEQ ID NO: 796107 - protein, 132 aa, Homo sapiens
KLGLRNKGPEPGEAGVPGLLCSHRLSRSPWLSEDPRPEPSLRKTDFFQTTLLSLILNRRLIIIQKRQDEAWTKEVEGIKRYLEDKGSLDLVLWVYPPSWHTPGYFEANPRRHQTVQIAQVSPTHFFFLLQFV

SEQ ID NO: 796108 - protein, 86 aa, Homo sapiens
MRVGPALAVERLVAPGPLLVLRASLRRAAQRAQPLPQLSPEPAVARLEEEVDEGIESAVGHRHHAQRRRQALSLPVSRGPGRPRGR

SEQ ID NO: 796109 - protein, 231 aa, Homo sapiens
PRPSPPDVFAGFAPHPAALGPPTLLADQMSVIGSRKKSVNMTECVPVPSSEHVAEIVGRQGCKIKALRAKTNTYIKTPVRGEEPVFIVTGRKEDVEMAKREILSAAEHFSIIRATRSKAGGLPGAAQGPPNLPGQTTIQVRVPYRVVGLVVGPKGATIKRIQQRTHTYIVTPGRDKEPVFAVTGMPENVDRAREEIEAHITLRTGAFTDAGPDSDFHANGTDVCLDLLGAA

SEQ ID NO: 796110 - protein, 113 aa, Homo sapiens
PEKPQVEILSSEGAGEPHSSPELAATPGGPVKAETEEAAHSVSQEMSVNSPTAQESQRNAETPAETPTTAEACSPSPAVQTFSEAKKTSTEPGCERKHYQLNFLLENEGVFSD

SEQ ID NO: 796111 - protein, 124 aa, Homo sapiens
IWSPENRNGKKMSFSTVNISYHWHDDHLSENKPQISMGTALLQRYYVYPHPAKRPSGEKPECPQSFSVCWARSELFSWIFLCCKSELYIDYSFIQKKNAILKKEMHVLLFPLLSQGGLDLKTSA

SEQ ID NO: 796112 - protein, 140 aa, Homo sapiens
MPSLLLLSFNKYSSVTEDAIKTNRTRPSPQKILLCPFPFYVHCYHATCADFSTMLPPVLRVHTNGSLGTCPCVRRLSLSVMFLEILLCCFMSQEFVLLIAKQSSVNTPVCLSAVFMDTWSCVWLLAITNKVAVDFLFEIF

SEQ ID NO: 796113 - protein, 78 aa, Homo sapiens
SIMLSQWTQVFARKLKVNGNMAGQTKKDKRAGHLGRCGSMSPSLGNILGAADHWPFVESGRLREATKGLRFRQPWLAT

SEQ ID NO: 796114 - protein, 507 aa, Homo sapiens
GSSLSPRGASAAPAPGWWLLSERRGVVADSLGVQLRSPAGSVRFVSGGLTYAGFSALAWENSSGDRWPPRAQIQGPLTFGDVAVAFTRIEWRHLDAAQRALYRDVMLENYGNLVSVGLLSSKPKLITQLEQGAEPWTEVREAPSGTHAVEDYWFETKMSALKQSTSEASVLGERTKSVMMEKGLDWEGRSSTEKNYKCKECGKVFKYNSSFISHQRNHTSEKPHKCKECGIAFMNSSSLLNHHKVHAGKQPYRCIECGKFLKKHSTFINHQRIHSREKPHKCIECGKTFRKNSILLSHQRIHTGQKPYKCNDCGKAFAQNAALTRHERIHSGEKPFKCNKCGRAFRDNSTVLEHQKIHTGEKPYQCNECGKAFRKSSTLISHQRMHTGEKPYHCSKCGKSFRYSSSFAGHQKTHSGNKPYQCRDCGKAFTKSSTLTGHQRIHTGEKPYHCKKCGKAFRHSSGLVEHQRLHTGEKPYKCNECGKAFPRSSALKQHKKIHNKERAMKCS

SEQ ID NO: 796115 - protein, 73 aa, Homo sapiens
RKTGSEPIYEHTVCCVVIRAWNNRELGKGVVVRGFAILDEVWRESLTYKDTFEKGLETMKEVSRQRKQQVQRP

SEQ ID NO: 796116 - protein, 106 aa, Homo sapiens
KEEKNCSGLLWSKIFTTFRDLHLGTGCPSLSPFLLWQVAALSLKRAAGMSFTVTSYITTVTGWLVLSESCPVASKSHEDRLLFPTTASAQCLSPRLKKLIIFTIWS

SEQ ID NO: 796117 - protein, 33 aa, Homo sapiens
RRGTWTSTFRGEHLGVEGVERSHPEWSPGQPAT

SEQ ID NO: 796118 - protein, 143 aa, Homo sapiens
MIRLKAGARPGQCLRLSRLLVGTEEPGHICGTQGRPLSARLPHIVPLVQGRVEELLPRTGGAAGPLLHVRWDTPVSPPEGECRPLLSLVLQGSALSRKPGHPGRRLLRPGRRGGCPAWRETPALPAFSDAHPSQALFSLGSPV

SEQ ID NO: 796119 - protein, 99 aa, Homo sapiens
MLENSLCSPTWEGSQFWVTVQRTEAVEHCGLHASYVLRVEAERLTLLTMGAQSQVPELLLSWPYTLLHCYGRDKVMFSFEASAAASWALEPSFPDGTGK

SEQ ID NO: 796120 - protein, 101 aa, Homo sapiens
MSDAAVDTSSEITTEDLKEKKEVVEEAENGRDAPADEENGEQEADNEVDEEQEEGGEEEGDGEEEDGDEDEGAESATDKRAAEDDEDNDVDTKKQKTDEDD

SEQ ID NO: 796121 - protein, 77 aa, Homo sapiens
RFTFLFYLPQRLHDIPILMEGLSAHHPRKPDSKPILPFLRAPKRREKGLQLEAINKNAEWVIVFPKSQEQRRPRQGF

SEQ ID NO: 796122 - protein, 124 aa, Homo sapiens [sequence omitted]

SEQ ID NO: 796123 - protein, 165 aa, Homo sapiens
MTSGANSSGSYLPSEIRSSKIDDNYLKELNEDLKLRKQELLEMLKPLEDKNNLLFQKLMSNLEEKQRSLQIMRQIMAGKGCEESSVMELLKEAEEMKQNLERKNKMLRKEMEMLWNKTFEAEELSDQQKAPQTKNKADLQDGKRLFLPPGKATEENGMGQVSGTK

SEQ ID NO: 796124 - protein, 162 aa, Homo sapiens
MTSGANSSGSYLPSEISLQIMRQIMAGKGCEESSVMELLKEAEEMKQNLERKNKMLRKEMEMLWNKTFEAEELSDQQKAPQTKNKADLQDGKEKQQRKMEWVKYQEQNNILQNDFHGKVIELRIEALKNYQKANDLKLSLYLQQNFEPMQAFLNLPGSQAFP

SEQ ID NO: 796125 - protein, 165 aa, Homo sapiens; identical to SEQ ID NO: 796123

SEQ ID NO: 796126 - protein, 106 aa, Homo sapiens
MTSGANSSGSYLPSEIRSSKIDDNYLKELNEDLKLRKQELLEMLKPLEDKNNLLFQKLMSNLEEKQRSLQIMRQIMAGKGCEESSVMELLKEAEEMKQNLHFLELF

SEQ ID NO: 796127 - protein, 127 aa, Homo sapiens
MAVDRYVAFCNPLHYPGVMSQRLCIKLLVSSYVMGFLNASINISFTFSLNFCKSKTINHFFCDEPPIIALPCSNIDLNIMLLTVFVGLNLMCTVMVVIISCIYVLVAILRISSAAGKKKVSLHVPPT

SEQ ID NO: 796128 - protein, 152 aa, Homo sapiens
ANSFPFPAAPHPALPPSLHGSFLHLPHSLPSVSLFLPSVCPLSVLPSLLPLSYFLSPFSWLSFPPVSPLPCTPRPTRCCPGSATISWVPACLVLLPSSILSCPCPLPCSPSSLSFPSVFYSVHTRFLPDSLPPCFLTSMSLHSSLGNKTKLH

SEQ ID NO: 796129 - protein, 150 aa, Homo sapiens
ANSFPFPAAPHPALPPSLHGSFLHLPHSLPSVSLFLPSVCPLSVLPSLLPLSYFLSPFSWLSFPPVSPLPCTPRPTRCCPGSATISWVPACLVLLPSSILSCPCPLPCSPSSLSFPSVFYSVHTRFLPDSLPPCFLTSMSLPSANFPFPR

SEQ ID NO: 796130 - protein, 164 aa, Homo sapiens
YVSARTDLAQMQKPQPVNPELTSWCITGVLDMLNNFRVDSALSTEMIPCYISLSEDVRYVIFGDDHLSAPTDPQGVDSFAVWGAQAFTSGKHYWEVDVTLSSNWILGVCQDSRTADANFVIDSDERFFLISSKRSNHYSLSTNSPPLIQYVQRPLGQSWGVSGL

SEQ ID NO: 796131 - protein, 72 aa, Homo sapiens
RVQAACGLESQSQPEALKPTWVTGQGEPSEIKQSQTERAWGRRMYLQAVGTCLWRMSLGSQGQDENDHNHEI

SEQ ID NO: 796132 - protein, 157 aa, Homo sapiens
SGGEEENDVQAGAGEARAKALRGSAAMNLRGWILLTHLGYQGQTKDMESRPRRRYQASSFTDAPVMTMTASLLPLVPDSVSAVTRHQAGSKEPSLSPAPTNSYGAPFPRLGLLSTQFLITYHEKLSPWQLSPSGEIYNCTATTACGMVKLHQDLCCP

SEQ ID NO: 796133 - protein, 157 aa, Homo sapiens; identical to SEQ ID NO: 796132

SEQ ID NO: 796134 - protein, 157 aa, Homo sapiens; identical to SEQ ID NO: 796132

SEQ ID NO: 796135 - protein, 103 aa, Homo sapiens
REAVWEARGSARKVEGAQLGREDSVCARKRERKREVCGIPAPCVSGCDRAGPRPSRPLERDFGRWLPGRLRLSVGPEQVPGAGRGVRDRSPARAAAGVGKAHL

SEQ ID NO: 796136 - protein, 384 aa, Homo sapiens
MNTFQASVSFQDVTVEFSQEEWQHMGPVERTLYRDVMLENYSHLVSVGYCFTKPELIFTLEQGEDPWLLEKEKGFLSRNSPEDSQPDEISEKSPENQGKHLLQVLFTNKLLTTEQEISGKPHNRDINIFRARMMPCKCDIAGSACQGLSLMAPHCQYSKEKAHERNVCDKWLISIKDGRTNTQEKSFAYSKIVKTLHHKEEVIQHQTIQTLGQDFEYNESRKAFLEKAALVTSNSTHPKGKSYNFNKFGENKYDKSTFIIPQNMNPEKSHYEFNDTGNCFCRITHKTLTGGKSFSQKSHIREHHRVHIGVKPFEYGKSFNRNSTLPVHQRTHATDKYSDYHPCTETFSYQSTFSVHQKVHIRAKPYEYNECGKSCSMNSHLIWP

SEQ ID NO: 796137 - protein, 113 aa, Homo sapiens
ASVSFQDVTVEFSQEEWQHMGPVERTLYRDVMLENYSHLVSVGEHSLPWGSLQSAVLFLLSFSLSIPYHVTPSTVQFWFSFFILVTFIEVYLTENKIQHLSVYKSMSFEKCIH

SEQ ID NO: 796138 - protein, 503 aa, Homo sapiens
SSWAAISGTDAQKTSCSTTTSSLRAPRKTSTSSPADESSCAPERSSTELRRTSGIRMRVCPSRDTRRIDVGGSSSTRSTSSRGTRRAQPAARTTMEHFEYIIPLSPGGQDSALRGFPCMWVLQELGVTGIPPNHFRRKWLLIIMAPLGTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 796139 - protein, 69 aa, Homo sapiens
IRPHGVTVPSTLRGSCVMCTNALYFSYDNSQGPITGRSHSNTMTVKQPQFPDAPQTCPAWLPGSYFCIL

SEQ ID NO: 796140 - protein, 125 aa, Homo sapiens [sequence omitted]

SEQ ID NO: 796141 - protein, 138 aa, Homo sapiens
MVLQENGYGVEEDIPTLLMAASSMDDILAITGFNTCLSIVFSSDKTYVEERIPCLDYVCFCCLRQPTYRFTWIWQDYAHSVEFHCTGQNGPNEHDESPKDYYQMCGTIFQPLLYGIGWTQEVSVHRLNSHIVAYLLAL

SEQ ID NO: 796142 - protein, 110 aa, Homo sapiens
MVDFVLGAVSPVVVVLYTMVLQENGYGVEEDIPTLLMAASSMDDILAITGFNTCLSIVFSSGCARSSGSRNSKSLRTPLGTICEGCDDSSIFSHLDHSSKWSSTYGHSGA

SEQ ID NO: 796143 - protein, 213 aa, Homo sapiens
PGVQAAPSPACPAAATMTLLPGLLFLTWLHTCLAHHDPSLRGHPHSHGTPHCYSAEELPLGQAPPHLLARGAKWGQALPVALVSSLEAASHRGRHERPSATTQCPVLRPEEVLEADTHQRSISPWRYRVDTDEDRYPQKLAFAECLCRGCIDARTGRETAALNSVRLLQSLLVLRRRPCSRDGSGLPTPGAFAFHTEFIHVPVGCTCVLPRSV

SEQ ID NO: 796144 - protein, 158 aa, Homo sapiens
GPQRLRRHPGKAARPGPETPGCFHQSPRTLPARAEHASSLPGGYKGAPPSAPVSSASISWDPRRQPGQASEWPQSPGWTRPRRQRSARGLGGHPFRVGPVLATVTCWLDSGNPLSEDHRGVSLTTPNRIRPDLKLPSPLWLPSALFISSLNLLGISVS

SEQ ID NO: 796145 - protein, 228 aa, Homo sapiens
MFRAGTPMPPNLNSQGGGHYFIDRDGKAFRHILNFLRLGRLDLPRGYGETALLRAEADFYQIRPLLDALRELEASQGTPAPTAALLHADVDVSPRLVHFSARRGPHHYELSSVQVDTFRANLFCTDSECLGALRARFGVASGDRAEGSPHFHLEWAPRPVELPEVEYGRLGLQPLWTGGPGERREVVGTPSFLEEVLRVALEHGFRLDSVFPDPEDLLNSRSLRFVRH

SEQ ID NO: 796146 - protein, 131 aa, Homo sapiens
PKSALIPVIPITKSTGSRFRNSVEGLNQEIEIIIKETGEKEEQLIPQDIPDGHRAPPPLVQRSSSTRSIDTQTPGGADRGSNNSSRSQSVSPTSFLTISNEGSEESPCSADDLLVDPRDKENGNNSPLPKY

SEQ ID NO: 796147 - protein, 130 aa, Homo sapiens
PKSALIPVIPITKSTGSRFRNSVEGLNQEIEIIIKETGEKEEQLIPQDIPDGHRAPPPLVQRSSSTRSIDTQTPGGADRGSNNSSRSQSVSPTSFLTISNEGSEESPCSADDLLVDPRDKGTVLEECATR

SEQ ID NO: 796148 - protein, 838 aa, Homo sapiens
MTQGKCGTDHAAQLGQFLASSSLSLPVSRSLLSSPLSPSFSNLMGSFGHKGRFLSDFFYAFGPRDTATPTPYPKSLQTAAPEKRTKLGTYLFPVLQKCLFEKQHSKVEWFDLISKSKCISSKTETILQLAVIELCDDSGRQCWVTDAASWSRVRRRGHVTLVKGLGFLGRAEDPGLVFKAEVTANCPLEETQVSAPTCVVWKVTLRSWGRQWLDLYGFGSFAAALNLPLMAVASFVPLIPFPIFITHSSSRPPSLGFTYGLALSLRCGLCCIPGPPRSAVWTPCVVMPGNPAGCWTYTQETLGTVCPHRYMLPTSAWVSSDCKPVLRCQIETPETLNLSSRSPDLPLGARHADILQKETSAPFGVVKMSWNLAGVVVAQLRKWSKCSGLVGFEMVTSSFLFFFFFFFFLRRSLALLPRLECSGVILAHCSLCLPGSSDSPASASRVAGTTGTRHDAWLNFEFLVETGFHHVGQTGLELLTSNDPPASASQSARITEVKWLLLYYVNGFTSMNKNKQDNKNFESPNTINWAQLKVSEHTQPEMEIVMDTKSPSEQGRSWRSQEGRGTAATALGTSQARVGEGWGGHWADMRQPFLSATGCPPGAAGRGQGLPSYGWEGAGSPAAPPVLKICLLSALARPRVPVRDHDSLWSVGCSFPGVTRELGLGHCVHQAANTKGPGLLREAAPRWHLLPVPHCPQASRRILHTLDLCQALWVQERMNQMWSTLRGLQLELPEPRGSEVKGCWKGTKLEEMFSEPKVQFHCRGWLLLGVRLCTGKMPCPAFSPRGQWACLTWDLQMQQLHAESTQQWPPGSPVDTSFVPQNETILSTAFAYGSQEIG

SEQ ID NO: 796149 - protein, 93 aa, Homo sapiens
DDDGGGNEGGDGDGGGDDGGSGGDDGGCDGDDGGDGGDDDGDHDDGDGGYGGDDGDDDGDGGGDGDDDDSDDGGDDANDDGGGCHALLTSGKD

SEQ ID NO: 796150 - protein, 148 aa, Homo sapiens
MGPEEKTIMTERSAAVFIQAWWRGMLVRRTLLHAALRAWIIQCWWRQVLEKLLAKRRRMVLEFYVQQEWAAVRLQSWVRMWCVRQRYCRLLNAVRIIQVYWRWHSCHSRVFIEGHYELKENQLNIQLEISLGLQACKVQQCIPLPLKE

SEQ ID NO: 796151 - protein, 131 aa, Homo sapiens
MGPEEKTIMTERSAAVFIQAWWRGMLVRRTLLHAALRAWIIQCWWRQVLEKLLAKRRRMVLEFYVQQEWAAVRLQSWVRMWCVRQRYCRLLNAVRIIQVYWRWHSCHSRVFIEGHYELKENQRRSDTDPFR

SEQ ID NO: 796152 - protein, 109 aa, Homo sapiens
MGPEEKTIMTERSAAVFIQAWWRGMLVRRTLLHAALRAWIIQCWWRQVLEKLLAKRRRMVLESIGAGTAAIPVSLLRATMNSKKTNLIFNLKSLWAYRLVRCNNAYPFH

SEQ ID NO: 796153 - protein, 100 aa, Homo sapiens
GEPAETAPCTVLRVRLKHTQTSGVARSCCVPEPLGPVAATRGIPTREDLSIVLKGRFRWRRPENRLECCLRAVLPAGPEPAQTFTLTPACRRHCCLVMLR

SEQ ID NO: 796154 - protein, 270 aa, Homo sapiens
GFRGGFGSGIRGRGRGRGRGRGRGRGARGGKAEDKEWMPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 796155 - protein, 192 aa, Homo sapiens
AHHPGLQSEIHFFRGKKKSGGGPVHASAPFNASGHVGLGVKCSKEVATAIRGAIILAKLSIVPVRRGYWGNKIGKPHTVPCKVTGRCGSVLVRLIPAPRGTGIVSAPVPKKLLMMAGIDDCYTSARGCTATLGNFAKATFDAISKTYSYLTPDLWKETVFTKSPYQEFTDHLVKTHTRVSVQRTQAPAVATT

SEQ ID NO: 796156 - protein, 281 aa, Homo sapiens
PRKLLGHGLPDRWAVRQRLSEAAPGAMSSHRRKAKGRNRRSHRAMRVAHLELATYELAATESNPESSHPGYEAAMADRPQPGWRESLKMRVSKPFGMLMLSIWILLFVCYYLSYYLCSGSSYFVLANGHILPNSENAHGQSLEEDSALEALLNFFFPTTCNLRENQVAKPCNELQDLSESECLRHKCCFSSSGTTSFKCFAPFRDVPKQMMQMFGLGAISLILVCLPIYCRSLFWRSEPADDLQRQDNRVVTGLKKQRRKRKRKSEMLQKAARGREEHGDE

SEQ ID NO: 796157 - protein, 102 aa, Homo sapiens
MRNDISLLGPTFVLYSFIYLPSTRHMPHTVLGLEEGAKSKNTWVLSHDAQFADDTRNKRKLCRRDILADMGKMKELNGASISGKRRSNFQRLEEDSGACWDT

SEQ ID NO: 796158 - protein, 104 aa, Homo sapiens
MNHTVQTLFTPANTGRSTNHEMLKEKHEVAVLGAPHNPVPPAFTMIQRMAQQLTYSEYGCRGGGGVCVCVCVCVYVCVCVYTRCVHQYQCLPRVGKLHPVVCME

SEQ ID NO: 796159 - protein, 122 aa, Homo sapiens
PDDSNSGEDSEPSQQPNHSWFSLETMNHTVQTLFTPANTGRSTNHEMLKEKHEVAVLGAPHNPVPPAFTMIHICSETSVPDHVVWSLFNTLFKNSCCPDFIAFIYSVKSRTGSLWTGRWLVT

SEQ ID NO: 796160 - protein, 122 aa, Homo sapiens; identical to SEQ ID NO: 796159

SEQ ID NO: 796161 - protein, 120 aa, Homo sapiens
MFSLPSRDEPSQQPNHSWFSLETMNHTVQTLFTPANTGRSTNHEMLKEKHEVAVLGAPHNPVPPAFTMIHICSETSVPDHVVWSLFNTLFKNSCCPDFIAFIYSVKSRTGSLWTGRWLVT

SEQ ID NO: 796162 - protein, 299 aa, Homo sapiens
MAPWSHPSAQLQPVGGDAVSPALMVLLCLGLSLGPRTHVQAGNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGAADNLSPSQNKSDSGTASHLQDYAVENLIRMGMAGLILVVLGILIFQDWHSQRSPQAAAGR

SEQ ID NO: 796163 - protein, 69 aa, Homo sapiens
PLICDTGQALLGLDFPSIVQLKVETTKPYGLGQLLGPNSPESWHEWTKRMPLVTASWASSLFDWLADTG

SEQ ID NO: 796164 - protein, 88 aa, Homo sapiens
CSAQCGLGQQMRTVQCLSYTGQASSDCLETVRPPSMQQCESKCDSTPISNTEECKDVNKVAYCPLVLKFKFCSRAYFRQMCCKTCQGH

SEQ ID NO: 796165 - protein, 69 aa, Homo sapiens
LWKKPGLSYILNLPLATCFSSLLTGNQISHGRNSRQTEQTAQEGDFEDAAFWTEGRGKEHRSRRKQYRK

SEQ ID NO: 796166 - protein, 160 aa, Homo sapiens
MLPFLFFSTLFSSIFTEAQKQYWVCNSSDASISYTYCDKMQYPISINVNPCIELKGSKGLLHIFYIPRRDLKQLYFNLYITVNTMNLPKRKEVICRGSDDDYSFCRALKGETVNTTISFSFKGIKFSKGKYKCVVEAISGSPEEMLFCLEFVILHQPNSN

SEQ ID NO: 796167 - protein, 1184 aa, Homo sapiens [sequence omitted]

SEQ ID NO: 796168 - protein, 683 aa, Homo sapiens
MVGTKAWVFSFLVLEVTSVLGRQTMLTQSVRRVQPGKKNPSIFAKPADTLESPGEWTTWFNIDYPGGKGDYERLDAIRFYYGDRVCARPLRLEARTTDWTPAGSTGQVVLVVPVRVSGASTGVTFLDPRNISTATAAQTDLNFINDEGDTFPLRTYGMFSVDFRDEVTSEPLNAGKVKVHLDSTQVKMPEHISTVKLWSLNPDTGLWEEEGDFKFENQRRNKREDRTFLVGNLEIRERRLFNLDVPESRRCFVKVRAYRSERFLPSEQIQGVVISVINLEPRTGFLSNPRAWGRFDSVITGPNGACVPAFCDDQSPDAYSAYVLASLAGEELQAVESSPKFNPNAIGVPQPYLNKLNYRRTDHEDPRVKKTAFQISMAKPRPNSAEESNGPIYAFENLRACEEAPPSAAHFRFYQIEGDRYDYNTVPFNEDDPMSWTEDYLAWWPKPMEFRACYIKVKIVGPLEVNVRSRNMGGTHRRTVGKLYGIRDVRSTRDRDQPNVSAACLEFKCSGMLYDQDRVDRTLVKVIPQGSCRRASVNPMLHEYLVNHLPLAVNNDTSEYTMLAPLDPLGHNYGIYTVTDQDPRTAKEIALGRCFDGTSDGSSRIMKSNVGVALTFNCVERQVGRQSAFQYLQSTPAQSPAAGTVQGRVPSRRQQRASRGGQRQSGVVASLRFPRVAQQPLIN

SEQ ID NO: 796169 - protein, 81 aa, Homo sapiens
CGQGLHCLSHCENSGKSWPILGQFLHILATQSVLHGLVASASPRNVLETQNRVTAPDLLMQNLHFSKRPTAPAPPDDLGAH

SEQ ID NO: 796170 - protein, 104 aa, Homo sapiens
MHCWDCHAQHGPLPWGSARRADSLLVPACLPACTGQETWGGDPQAKAPHSDALLHPMTGPGRGLAAAEMVSGLPTSPTHFPVGAFLKSKETHSFKYVLSACQWL

SEQ ID NO: 796171 - protein, 77 aa, Homo sapiens
ENTGGKQASNRNSNRFQETDEYGCSRQGQPWLSVSNPCQLSGPASRTASELATISPPCLHLPPYPTPAHSALPPTGN

SEQ ID NO: 796172 - protein, 165 aa, Homo sapiens
MSAWELTHLSGKEGMASQPTEAHWGHRTSPQSRDSPSRKSDQALRGHGLRTRSREDTVTNPWLIWQVWEAARPVASPAPPDLCLQLSCSLGQAPRQLYGRRRCTTHILFPGRACCPGCSECGSRWPPAISNFRELPCLRSRPFWGSSHLPGGYKSTVDTMMGNSG

SEQ ID NO: 796173 - protein, 161 aa, Homo sapiens
MVVQNSADAGDMRAGVQLEPFLHQVGGHMSVMKYDEHTVCKPLVSREQRFYESLPLAMKRFTPQYKGTVTVHLWKDSTGHLSLVANPVKESQEPFKVSTESAAVAIWQTLQQTTGSNGSDCTLAQWPHAQLARSPKESPAKALLRSEPHLNTPAFSLVEDT

SEQ ID NO: 796174 - protein, 138 aa, Homo sapiens
MVVQNSADAGDMRAGVQLEPFLHQVGGHMSVMKYDEHTVCKPLVSREQRFYESLPLAMKRFTPQYKGTVTVHLWKDSTGHLSLVANPVKESQEPFKVSTESAAVAIWQTLQQTTGSNGSDCTLAQWPHAQLARSPKER

SEQ ID NO: 796175 - protein, 68 aa, Homo sapiens
SCWAGVGGGVGEMSQRVALDAKPPCSPPSCALRAVERGVEGGGAIFASASREAKEQPWAPLLTVAMGR

SEQ ID NO: 796176 - protein, 124 aa, Homo sapiens
KTVARWAKGPSHPRPSLSLKTFGSNPTISRALLSSSLCVSPQGCWLVSRSPPDPTSGVPPGVWGGSAAWLAVEPYGTWCLTGSLLGVLDPGCIPLERMCVGLRYVYNRNIYSEALVKTSFLSSE

SEQ ID NO: 796177 - protein, 94 aa, Homo sapiens
TGPRCPRSPGAAALGDKGEEEAKEVGNDSPILPTRVMDPGPQEEEAVRGSGVTLGLTALIIHRMCTLTSQTLFCSLKISPINYDPSYLLPQQHI

SEQ ID NO: 796178 - protein, 87 aa, Homo sapiens
KKDPFAKSVAASSVPETKLAGSNSDPTSDPAATIEITPLQESTIIPQDASRLWRRQMRELSGVMVKNRAFRPLRVALVSTVPPGTQY

SEQ ID NO: 796179 - protein, 102 aa, Homo sapiens
FIVSPGPPVTVPVFLPTPSAGVFQNTSLVPRGVFFLGGIPPPFVLAPRSSSGPPRGAPVSLCLCAARPPTTLSVFSKNFFSRPDCGPHSGFFCLCMSLCFLN

SEQ ID NO: 796180 - protein, 134 aa, Homo sapiens
KFRNLILWKFLNQKMSHKNWNFWLLWEIRILSLSEVPPHAGSQRTEPQLLLEAPPGPKPHSPHYSLSPGTEAACQLPFITEKTLSYFLYWRVCCCCCFWLNLLLNHVFIQPLTTSLISITCAPLQAAGPRVDCD

SEQ ID NO: 796181 - protein, 67 aa, Homo sapiens
QSECEGLRTRRAKFQSEDRRRPRSQLKQAGGVALAQPFILSRSSGDWMRPTYISEGNLFYVFDRLKY

SEQ ID NO: 796182 - protein, 330 aa, Homo sapiens
MVDCSLLTLCARKGTAPWYKCCWAPFCFLSFLNPIQVCSTLLGRLMRPRGMLERTERKSNKAASGVRGQHALWVFCHSSRTSTIRKGDPGPTFSKMFIWTSGRTSSSYRHDEKRNIYQKIRDHDLLDKRKTVTALKAGEDRAILLGLAMMVCSIMMYFLLGITLLRSYMQSVWTEESQCTLLNASITETFNCSFSCGPDCWKLSQYPCLQVYVNLTSSGEKLLLYHTEETIKINQKCSYIPKCGKNFEESMSLVNVVMENFRKYQHFSCYSDPEGNQKSVILTKLYSSNVLFHSLFWPTCMMAGGVAIVAMVKLTQYLSLLCERIQRINR

SEQ ID NO: 796183 - protein, 235 aa, Homo sapiens
MFIWTSGRTSSSYRHDEKRNIYQKIRDHDLLDKRKTVTALKAGEDRAILLGLAMMVCSIMMYFLLGITLLRSYMQSVWTEESQCTLLNASITETFNCSFSCGPDCWKLSQYPCLQVYVNLTSSGEKLLLYHTEETIKINQKCSYIPKCGKNFEESMSLVNVVMENFRKYQHFSCYSDPEGNQKSVILTKLYSSNVLFHSLFWPTCMMAGGVAIVAMVKLTQYLSLLCERIQRINR

SEQ ID NO: 796184 - protein, 103 aa, Homo sapiens
MMPAVPREKAKASRPPRPYIVWPIPQTSSLLFLPLPPPTAMLASLLLLKQKHPAPPASGPLHVLCPLPSPQHPWGASPPSSRLCSKAPFSEKPSLTPTYTTAP

SEQ ID NO: 796185 - protein, 93 aa, Homo sapiens
SCSGGEWGADLVFAHAVAGHLRPELEIRLGIGGPGGSEAGSPRAARPGAAAPRWSPGLERGAGLGAPEGLIYGTPPPSSFLPFPALWRMRRDQ

SEQ ID NO: 796186 - protein, 71 aa, Homo sapiens
RDRRSHSPPALSAPRRSGRWPSLGGLRERGRRRLDWRASGLRERSPRVTLGEAPPRAAAWSPSSLYFLNFL

SEQ ID NO: 796187 - protein, 224 aa, Homo sapiens
MRVSGVLRLLALIFAIVTTWMFIRSYMSFSMKTIRLPRWLAASPTKEIQVKKYKCGLIKPCPANYFAFKICSGAANVVGPTMCFEDRMIMSPVKNNVGRGLNIALVNGTTGAVLGQKAFDMYSGDVMHLVKFLKEIPGGALVLVASYDDPGTKMNDESRKLFSDLGSSYAKQLGFRDSWVFIGAKDLRGKSPFEQFLKNSPDTNKYEGWPELLEMEGCMPPKPF

SEQ ID NO: 796188 - protein, 224 aa, Homo sapiens; identical to SEQ ID NO: 796187

SEQ ID NO: 796189 - protein, 143 aa, Homo sapiens [sequence omitted]

SEQ ID NO: 796190 - protein, 321 aa, Homo sapiens
NEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVSARS

SEQ ID NO: 796191 - protein, 189 aa, Homo sapiens
NEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVERPSRT

SEQ ID NO: 796192 - protein, 315 aa, Homo sapiens
NEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLETVSYRSQLQTFWYRP

SEQ ID NO: 796193 - protein, 111 aa, Homo sapiens
MPTGTSERSAVLSLGGEKEPASAGAHRMSRVSLLLPRLECNGMILAHCNLRLLDSSNSPASASQIDSRHCMEKHRENPWPVLLCSDYRCVQPAVTYPLVAQSITTLSHGPP

SEQ ID NO: 796194 - protein, 35 aa, Homo sapiens
MTLHKATLYELSALSCTTPVHAVTPPSRLVSLMML

SEQ ID NO: 796195 - protein, 79 aa, Homo sapiens
KVETLDIVLRAVGKHGRSVSTVRTVSTMEDRQEGVRLTGRVQWLTPVIPKCRRDYRREPPCLAFIISFLKMKKFIIYIQ

SEQ ID NO: 796196 - protein, 1395 aa, Homo sapiens
MLLPLPPQSSKPVPKKSQSSKIVPSHHDPSEKTGENCQTKISPSSLQESPSSLQGALKKRSAFEDLTNASQCQPVQPKKEANKEFVKVVSKKINRNTHALGLAKKNKRNLKWHKLEVTPVVASTTVVPNIMEKPLILDISTTSKTPNTEEASLFRKPLVLKEEPTIEDETLINKSLSLKKCSNHEEVSLLEKLQPLQEESDSDDAFVIEPMTFKKTHKTEEAAITKKTLSLKKKMCASQRKQSCQEESLAVQDVNMEEDSFFMESMSFKKKPKTEESIPTHKLSSLKKKCTIYGRICHFRKPPVLQTTICGAMSSIKKPTTEKETLFQELSVLQEKHTTEHEMSILKKSLALQKTNFKEDSLVKESLAFKKKPSTEEAIMMPVILKEQCMTEGKRPRLKPLVLQEITSGEKSLIMKPLSIKEKPSTEKESFSQEPSALQKKHTTQEEVSILKEPSSLLKSPTEESPFDEALAFTKKCTIEEAPPTKKPLILKKKHATQGTMSHLKKPLILQTTSGEKSLIKEPLPFKEEKVSLKKKCTTQEMMSICPELLDFQDMIGEDKNSFFMEPMSFRKSPTTEETVLTKTSLSLQEKKITQGEMSHLKKPLVLQKITSEEESFYKKLLPFKMKSTTEEKFLSQEPSALKEKHTTLQEVSLSKESLAIQEKATTEEEFSQELFSLHVKHTNKSGSLFQEALVLQEKTDAEEDSLKNLLALQEKSTMEEESLINKLLALKEELSAEAATNIQTQLSLKKKSTSHGKVFFLKKQLALNETINEEEFLNKQPLALEGYPSIAEGETLFKKLLAMQEEPSIEKEAVLKEPTIDTEAHFKEPLALQEEPSTEKEAVLKEPSVDTEAHFKETLALQEKPSIEQEALFKRHSALWEKPSTEKETIFKESLDLQEKPSIKKETLLKKPLALKMSTINEAVLFEDMIALNEKPTTGKELSFKEPLALQESPTYKEDTFLKTLLVPQVGTSPNVSSTAPESITSKSSIATMTSVGKSGTINEAFLFEDMITLNEKPTTGKELSFKEPLALQESPTCKEDTFLETFLIPQIGTSPYVFSTTPESITEKSSIATMTSVGKSRTTTESSACESASDKPVSPQAKGTPKEITPREDIDEDSSDPSFNPMYAKEIFSYMKEREEQFILTDYMNRQIEITSDMRAILVDWLVEVQVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 796197 - protein, 287 aa, Homo sapiens
MITPREDIDEDSSDPSFNPMYAKEIFSYMKEREEQFILTDYMNRQIEITSDMRAILVDWLVEVQVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 796198 - protein, 291 aa, Homo sapiens
MLLPLPPQSSKPVPKKSQSSKIVPSHHDPSEKTGENCQTKISPSSLQESPSSLQGALKKRSAFEDLTNVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 796199 - protein, 1434 aa, Homo sapiens
SGVGLRGVAAVSGSSSFKIVSLLGLVYCVMNAIAGELELVPCSEVLMVQVENRANGLIPVSCFTLYSSLTRTGENCQTKISPSSLQESPSSLQGALKKRSAFEDLTNASQCQPVQPKKEANKEFVKVVSKKINRNTHALGLAKKNKRNLKWHKLEVTPVVASTTVVPNIMEKPLILDISTTSKTPNTEEASLFRKPLVLKEEPTIEDETLINKSLSLKKCSNHEEVSLLEKLQPLQEESDSDDAFVIEPMTFKKTHKTEEAAITKKTLSLKKKMCASQRKQSCQEESLAVQDVNMEEDSFFMESMSFKKKPKTEESIPTHKLSSLKKKCTIYGRICHFRKPPVLQTTICGAMSSIKKPTTEKETLFQELSVLQEKHTTEHEMSILKKSLALQKTNFKEDSLVKESLAFKKKPSTEEAIMMPVILKEQCMTEGKRPRLKPLVLQEITSGEKSLIMKPLSIKEKPSTEKESFSQEPSALQKKHTTQEEVSILKEPSSLLKSPTEESPFDEALAFTKKCTIEEAPPTKKPLILKKKHATQGTMSHLKKPLILQTTSGEKSLIKEPLPFKEEKVSLKKKCTTQEMMSICPELLDFQDMIGEDKNSFFMEPMSFRKSPTTEETVLTKTSLSLQEKKITQGEMSHLKKPLVLQKITSEEESFYKKLLPFKMKSTTEEKFLSQEPSALKEKHTTLQEVSLSKESLAIQEKATTEEEFSQELFSLHVKHTNKSGSLFQEALVLQEKTDAEEDSLKNLLALQEKSTMEEESLINKLLALKEELSAEAATNIQTQLSLKKKSTSHGKVFFLKKQLALNETINEEEFLNKQPLALEGYPSIAEGETLFKKLLAMQEEPSIEKEAVLKEPTIDTEAHFKEPLALQEEPSTEKEAVLKEPSVDTEAHFKETLALQEKPSIEQEALFKRHSALWEKPSTEKETIFKESLDLQEKPSIKKETLLKKPLALKMSTINEAVLFEDMIALNEKPTTGKELSFKEPLALQESPTYKEDTFLKTLLVPQVGTSPNVSSTAPESITSKSSIATMTSVGKSGTINEAFLFEDMITLNEKPTTGKELSFKEPLALQESPTCKEDTFLETFLIPQIGTSPYVFSTTPESITEKSSIATMTSVGKSRTTTESSACESASDKPVSPQAKGTPKEITPREDIDEDSSDPSFNPMYAKEIFSYMKEREEQFILTDYMNRQIEITSDMRAILVDWLVEVQVSFEMTHETLYLAVKLVDLYLMKAVCKKDKLQLLGATAFMIAAKFEEHNSPRVDDFVYICDDNYQRSEVLSMEINILNVLKCDINIPIAYHFLRRYARCIHTNMKTLTLSRYICEMTLQEYHYVQEKASKLAAASLLLALYMKKLGYWVPFLEHYSGYSISELHPLVRQLNKLLTFSSYDSLKAVYYKYSHPVFFEVAKIPALDMLKLEEILNCDCEAQGLVL

SEQ ID NO: 796200 - protein, 232 aa, Homo sapiens
RFYNLIIIYVHLPGPEKAIKGVVVMDSALEALPSSYLLERFQKYGPKSYPSLKPWGSYITDFLARLNFLQDWYNSGKPCVFWLSGFFFTQAFLTGAMQNYARKYTTPIDLLGYEFEVIPSDTSDTSPEDGVYIHGLYLDGARWDRESGLLAEQYPKLLFDLMPIIWIKPTQKSRIIKSDAYVCPLYKTSERKGTLSTTGHSTNFVIAMLLKTDQPTRHWIKRGVALLCQLDD

SEQ ID NO: 796201 - protein, 232 aa, Homo sapiens; identical to SEQ ID NO: 796200

SEQ ID NO: 796202 - protein, 224 aa, Homo sapiens
KQNPGGAKWTKGDPQAGALGALGIRGIPSLCQSEGTRGSRRGRRWAERCPPGVLGAGRSLQAQRSAAGSIPGRRRSAHCANQPRSAAAAGTQEACLEASGTTRGWKYHALPLRLDPRSGHAGSALKAGGCLRLGGGGGEGERLAPPPPFGSRARCSSCCQMNPRMGTCNPPPHPQPQTSRSENWEGGAGSEVLEKQELTCKQAVLLSSGLLDHDVDILLNSLLP

SEQ ID NO: 796203 - protein, 412 aa, Homo sapiens
SKIPGEQNGRKATPRQGRWVPWESEESLLFASRRGLEGAEGPEMGRALPPGGPRRRAQLTSAAQRSRLHSRPPPLSPLRKPTPLCRRCWNPGSVLGGFGHYAGLEIPRTAPSPRPPLRPRGLCPQSWWLPQTWRWGRGRGEAGAPSPFWLPRSLQQLLPNEPQNGDVQPSTPPPATDVAVRKLGRGRWVRGSGKARTHLQTGSPSQLWTSGSRRRYPSEFALALNTSPLNKSLEKKQPLFPPQPNPLARFQLFVNIQLKMKPLAEAGAEGEVVSEVILGEKEEEEEGEEEEEGEVGFAFPDVTAQLLLAAAGFQFPPLLTMDGDDTKSHFLPHPPGPTAVGAEVPGTAREQSPAGRRAPARGEPRSGSRAHTPHGSHAGLPHPRTLAPAGGGSRAQAAAAPPARRRPSAPAA

SEQ ID NO: 796204 - protein, 74 aa, Homo sapiens
IALGGCDEVEGLPNLSLIRILLEELHQVQVIGLLPAIQLQQAVDTCFQKDSIIDGIQTHAQLLIPGDLSLAGKG

SEQ ID NO: 796205 - protein, 284 aa, Homo sapiens
RESISAQWLLAGTPPPINPSHRREKEAPGPTSWRNEATLQAVISGELDPHRPTAQLNRWWWAYPFLHYPDNNLPAPFKSVVEKSALSFGMGKLPRSDCKEGASSSPPIHPWDRQMDRQTHAHAHTHARAPHHTAPSRVRDRYGSPAPAPGWAVMGAQPGAAAQHRWETVPQGPPQDGRGGLSRSSRLLPRWSGRDPRPWSNVPRRLGARGGRYRARLPGTPAPSSQPEPLGANDRGRRRRSSRPGPREGGAGRGRGRGRGLPTPALPAAGGVWDRSDAVSQPGR

SEQ ID NO: 796206 - protein, 74 aa, Homo sapiens
CPDIAAHSGSCLCYIWSSHSLTQSQHLRQCLELPMPPQLAYKGVHSGWIPHSLTHTPLGTLCLAHPLQTWDPSS

SEQ ID NO: 796207 - protein, 95 aa, Homo sapiens
AHRGNSTLRLNYSSRWGCLCVVTCALQSPPALRGLLGGCWGASGRPVARGEAGSRRVTRLPGENGRRALTDPRAAMSWCAAAQEGTPLCQEEAAG

SEQ ID NO: 796208 - protein, 54 aa, Homo sapiens
MGWGGVIAIVVITLCHPNGILYLLLHLISRHQEYEKQLFCPQKGDLTLSNGITI

SEQ ID NO: 796209 - protein, 191 aa, Homo sapiens
MKLNISFPATGCQKLIEVDDERKLRTFYEKRMATEVAADALGEEWKGYVVRISGGNDKQGFPMKQGVLTHGRVRLLLSKGHSCYRPRRTGERKRKSVRGCIVDANLSVLNLVIVKKGEKDIPGLTDTTVPRRLGPKRASRIRKLFNLSKEDDVRQYVVRKPLNKEGKKPRTKAPKIQRLVTPRVLQHKRRR

SEQ ID NO: 796210 - protein, 634 aa, Homo sapiens
ESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFRLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKVPLQRAVDLLWVTSKTCIRKKSGKKKP

SEQ ID NO: 796211 - protein, 328 aa, Homo sapiens
THASPTRRWNKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKVPLQRAVDLLWVTSKTCIRKKSGKKKP

SEQ ID NO: 796212 - protein, 410 aa, Homo sapiens
EKLWDWDMWMRMPEQRRGRECIIPDVSRSYHFGIVGLNMNGYFHEAYFLALKEDKFPRFWKEVVEQGLLKMQFWPASYLCFRLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKVPLQRAVDLLWVTSKTCIRKKSGKKKP

SEQ ID NO: 796213 - protein, 380 aa, Homo sapiens
PKLDCAGTDLAKILPKWNLALKEDKFPRFWKEVVEQGLLKMQFWPASYLCFRLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKVPLQRAVDLLWVTSKTCIRKKSGKKKP

SEQ ID NO: 796214 - protein, 103 aa, Homo sapiens
MESRPASPVIGEGRLKPRGADTVVPLAWLKFRSPECGMRMWNSWISSIAVKLCSHSTNVWQTAEPGEGKTCSKIHMWPGSVAHACNPRTLGAKAGGSLKPSAS

SEQ ID NO: 796215 - protein, 69 aa, Homo sapiens
LEGRAPWPQGTKSDQEVAESLRHRSPRLHATSPSCSAHAHLTCQPHGVKKLRSPAAVSACGPATHKGSG

SEQ ID NO: 796216 - protein, 318 aa, Homo sapiens
MAETNNECSIKVLCRFRPLNQAEILRGDKFIPIFQGDDSVVIGGKPYVFDRVFPPNTTQEQVYHACAMQIVKDVLAGYNGTIFAYGQTSSGKTHTMEGKLHDPQLMGIIPRIARDIFNHIYSMDENLEFHIKVSYFEIYLDKIRDLLDVTKTNLSVHEDKNRVPFVKGCTERFVSSPEEILDVIDEGKSNRHVAVTNMNEHSSRSHSIFLINIKQENMETEQKLSGKLYLVDLAGSEKVSKTGAEGAVLDEAKNINKSLSALGNVISALAEGTKSYVPYRDSKMTRILQDSLGGNCRTTMFICCSPSSYNDAETKSTL

SEQ ID NO: 796217 - protein, 318 aa, Homo sapiens; identical to SEQ ID NO: 796216

SEQ ID NO: 796218 - protein, 35 aa, Homo sapiens
AASIPPLWGNCLLVFWVLYQGLGKDRTEGGARAGW

SEQ ID NO: 796219 - protein, 53 aa, Homo sapiens
MSSVWLCIPERLGKFAVRLLSNSRTDAKACRPKIVPLAVQTGKNLDSRNYILI

SEQ ID NO: 796220 - protein, 101 aa, Homo sapiens
NKLSSEKRNYEVNAYHQETWKRNKTFNLMRFIFRTDPQYTIEFGRQQRPKVGCFSQMIFKKHKSLPLHKRNNTREKSYECKEYKKGFRKYLHLTEHLRDHT

SEQ ID NO: 796221 - protein, 80 aa, Homo sapiens
QDGSPSCSLCTVLPLPPPEVPVTIVRGPHDLEVTEGDTATFECELSQALADVTWEKVRSQPQPSPLQCNTNDNNAPDRNS

SEQ ID NO: 796222 - protein, 136 aa, Homo sapiens
PGFSTCLTTGIKAACPPQPPHNLPLPARQRKETRATPREGPPLARHGNLGCSSLLPRLCLCGLVAESAQRAGRQVRSREAVLERGRTAHLALEASMTGCLQETERNFCPVSATGTPGPLLPCRKLGGFSETLSHSH

SEQ ID NO: 796223 - protein, 101 aa, Homo sapiens
VETGSQRYRTTQNPRDLSRKVTCSKRNYQGGKQPIEWEKIFTKYTSNKSLISKIYKEPNKQKANNPLKKWAKDMNRYFSKDVHVAHKHEKTPISNHQTNAN

SEQ ID NO: 796224 - protein, 149 aa, Homo sapiens
EQDAAGKRRAEPGLRAHSDSASPGTRRKLLAPAAEASPAWDSRGRGGDRGCTTSSAGRESAWCAGRVGEGLREAPAEAVAGAVAAALRPAHSAPRARGAPTPRPPPSPLLKGAIAPGAANSSAAQSPNLWRSPGPERSRRKRICSPRAS

SEQ ID NO: 796225 - protein, 1153 aa, Homo sapiens
MWSQGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGFFENSPLMSQPVWERYRPDRFLNSNSGLQGLQFYGLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 796226 - protein, 1102 aa, Homo sapiens
MWSQGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGFFENSPLMSQPVWERYRPDRFLNSNSGLQGLQFYGLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 796227 - protein, 2169 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGFFENSPLMSQPVWERYRPDRFLNSNSGLQGLQFYGLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 796228 - protein, 2117 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQSNTYQAILSTDGSRSYALFLYQSGGMQWDVAQRSGKPVLMGFSSGDGFFENSPLMSQPVWERYRPDRFLNSNSGLQGLQFYGLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 796229 - protein, 1827 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGFFENSPLMSQPVWERYRPDRFLNSNSGLQGLQFYGLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLELWGALSCVRTSPAL

SEQ ID NO: 796230 - protein, 2233 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLPVTDASSVSTGHATPLPVTDTSSASTGDTTPLPVTDTSSASTGQATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGFFENSPLMSQPVWERYRPDRFLNSNSGLQGLQFYGLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 796231 - protein, 1962 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLPVTDASSVSTGHATPLPVTDTSSASTGDTTPLPVTDTSSASTGQATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQAVGGLSYTRVSQEGPSCAPGLGEYTPIRGNVMKATAGSVDRAPATDRAVWRLQEEETHACFSRSCRFRHGEEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGFFENSPLMSQPVWERYRPDRFLNSNSGLQGLQFYGLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLELWGALSCVRTSPAL

SEQ ID NO: 796232 - protein, 1397 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLPVTDASSVSTGHATPLPVTDTSSASTGDTTPLPVTDTSSASTGQATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSRPPRAAVLRATPGRKAQLPSRVPAVAEEPASVAQLGLEPGLLPLFLAAGTTGLTIPTRQHRSLGPRQ

SEQ ID NO: 796233 - protein, 1221 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLPVTDASSVSTGHATPLPVTDTSSASTGDTTPLPVTDTSSASTGQATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYASQAGTLWPWWLRSGTMLTSPLVGGPHFIRNTRRSMVNTAC

SEQ ID NO: 796234 - protein, 1221 aa, Homo sapiens; identical to SEQ ID NO: 796233

SEQ ID NO: 796235 - protein, 1221 aa, Homo sapiens; identical to SEQ ID NO: 796233

SEQ ID NO: 796236 - protein, 1157 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYASQAGTLWPWWLRSGTMLTSPLVGGPHFIRNTRRSMVNTAC

SEQ ID NO: 796237 - protein, 1267 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSVEMAFSKTAH

SEQ ID NO: 796238 - protein, 1748 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLPVTDASSVSTGHATPLPVTDTSSASTGDTTPLPVTDTSSASTGQATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGFFENSPLMSQPVWERYRPDRFLNSNSGLQGLQFYGLHREERPNYRLECLQWLKSQPRWPSWGWNQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLELWGALSCVRTSPAL

SEQ ID NO: 796239 - protein, 1215 aa, Homo sapiens [sequence omitted]

SEQ ID NO: 796240 - protein, 1199 aa, Homo sapiens [sequence omitted]

SEQ ID NO: 796241 - protein, 1281 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQSNTYQAILSTDGSRSYALFLYQSGGMQWDVAQRSGKPVLMGFSRPPRAAVLRATPGRKAQLPSRVPAVAEEPASVAQLGLEPGLLPLFLAAGTTGLTIPTRQHRSLGPRQ

SEQ ID NO: 796242 - protein, 1201 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYASQAGTLWPWWLRSGTMLTSPLVGGPHFIRATPTKPSSPRTGAGPMPCFSTRAVGCSGTWPSAQWRWLFRKQPTDVPASVGEVSP

SEQ ID NO: 796243 - protein, 1786 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGFFENSPLMSQPVWERYRPDRFLNSNSGLQGLQFYGLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFEPVLPCELLLQSRPLLHLPDSGLSAHVHLPPSLH

SEQ ID NO: 796244 - protein, 1157 aa, Homo sapiens; identical to SEQ ID NO: 796236

SEQ ID NO: 796245 - protein, 1439 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLPVTDASSVSTGHATPLPVTDTSSASTGDTTPLPVTDTSSASTGQATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGFFENSPLMSQPVWERYRPDRFLNSNSGLQGLQFYGLHREERPNYRLECLQWLKSQPRWPSWGWNQVSCPCSWQQGRRDLRFQPVSIGQPPARVPEPHGGAPGGLE

SEQ ID NO: 796246 - protein, 2304 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLPVTDASSVSTGHATPLPVTDTSSASTGDTTPLPVTDTSSASTGQATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQAVGGLSYTRVSQEGPSCAPGLGEYTPIRGNVMKATAGSVDRAPATDRAVWRLQEEETHACFSRSCRFRHGEEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGFFENSPLMSQPVWERYRPDRFLNSNSGLQGLQFYGLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 796247 - protein, 1962 aa, Homo sapiens; identical to SEQ ID NO: 796231

SEQ ID NO: 796248 - protein, 1700 aa, Homo sapiens
MKGARWRRVPWVSLSCLCLCLLPHVVPGTTEDTLITGSKTPAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLPVTDASSVSTGHATPLPVTDTSSASTGDTTPLPVTDTSSASTGQATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGADAGDLEFVRRTVDFTSPLFKPATGFPLGSSLRDSLYFTDNGQIIFPESDYQIFSYPNPLPTGFTGRDPVALVAPFWDDADFSTGRGTTFYQAVGGLSYTRVSQEGPSCAPGLGEYTPIRGNVMKATAGSVDRAPATDRAVWRLQEEETHACFSRSCRFRHGEEYETFYGEHSLLVQQAESWIRKITNNGGYKARWALKVTWVNAHAYPAQWTLGSNTYQAILSTDGSRSYALFLYQSGGMQWDVAQRSGKPVLMGFSSGDGFFENSPLMSQPVWERYRPDRFLNSNSGLQGLQFYGLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRPALSVVNRIRSER

SEQ ID NO: 796249 - protein, 574 aa, Homo sapiens
SSARGYDDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 796250 - protein, 66 aa, Homo sapiens
SPHNGALERRIRENVLFPEPISLAKPFQGQKDLWRSEGKLRPGEGLPLTQEVGSDLRQGLHLPSPG

SEQ ID NO: 796251 - protein, 638 aa, Homo sapiens
GKTFSQTSYLVYHRRFHTGEKPYKCEECDKAFSFKSNLERHRKIHTGEKPYKCNECSRTFSRKSSLTRHRRLHTGEKPYKCNDCGKTFSQMSSLVYHRRLHTGEKPYKCEECDEAFSFKSNLERHRRIHTGEKPYKCNDCGKTFSQTSSLVYHRRLHTGEKPYKCEECDEAFSFKSNLERHRIIHTGEKLYKCNECGKTFSRKSSLTRHCRLHTGEKPYQCNECGKAFRGQSALIYHQAIHGIGKLYKCNDCHQVFSNATTIANHWRIHNEERSYKCNRCGKFFRHRSYLAVHWRTHSGEKPYKCEECDEAFSFKSNLQRHRRIHTGEKPYRCNECGKTFSRKSYLTCHRRLHTGEKPYKCNECGKTFGRNSALIIHKAIHTGEKPYKCNECGKAFSQKSSLTCHLRLHTGEKPYKCEECDKVFSRKSSLEKHRRIHTGEKPYKCKVCDKAFGRDSHLAQHTRIHTGEKPYKCNDCGKNFRHNSALVIHKAIHSGEKPYKCNECGKTFRHNSALEIHKAIHTGEKPYKCSECGKVFNRKANLSRHHRLHTGEKPYKCNKCGKVFNQQAHLACHHRIHTGEKPYKCNECGKTFRHNSVLVIHKTIHTGEKPYKCNECGKVFNRKAKLARHHRIHTGKKH

SEQ ID NO: 796252 - protein, 638 aa, Homo sapiens; identical to SEQ ID NO: 796251

SEQ ID NO: 796253 - protein, 47 aa, Homo sapiens
AAFGFCNLTKTLALLAYKMAKRGFSLMASVNKSMAFWSSPSFRASIA

SEQ ID NO: 796254 - protein, 115 aa, Homo sapiens
LETVSLSPRLECSGAISAHSICLPSSNNSAASASRVAGTTGAHRHARLIFCILVETGFHRVAQAGLELLSSGNPPSSASLSARITGASHRARPEFTLNINTTGERRGQVSGTKLI

SEQ ID NO: 796255 - protein, 75 aa, Homo sapiens
LAVPGGEPPTTNTAEVSLSSAIANPRSARRRGWEGAERKPGSEPRRRRILPVAGGSAQETPHRKWAGSLACCTRT

SEQ ID NO: 796256 - protein, 126 aa, Homo sapiens
PKLLASSDPPTSASQSAGIAGVSPRSWSTCHLLLTHLGAVGGRGHSTQSPRPGLVSGGRCALRLQTLSGSLPPAHCWGSPCRHIGLKKEIHYFMTSLLLFLEQVTHLHHRGSVSCSRTGLQRPSRE

SEQ ID NO: 796257 - protein, 422 aa, Homo sapiens
MLSLEETEAGEEGSRITLPGGGGCRRGDFPWDDEDFRSLALLGAGVAMGFFYLYFRDPGREITWKHFVQYYLARGLVDRLEVVNKQSVRVFLPLGPLLKRSWVRRIKLEIMEFVNFLKNPKQYQDLGAKIPKGAMLTGPPGTGKTLLAKATAGEATVPFITVNGSEFLEMFIGVVASKGFNSATNVVVLAGTNRPDVLDPALMRPGRFHRQIYTGPPYIKGRSSIFKVHLRPLKLDKSLNKDTLARKLALTPGFPGVHHTPGQGAPLRTVPAPGAAALHPGAALRPHVHDARGPGSRAAVLREITMGAQDDLRKVTQSAYAQVVQFGVSEKLGQVSFDFSRHGKTLVEKLYGEASAQLLDDEVRHLVSATYRCTLDLLTRCREHVEKVGQRLLEKEVLEKADMVELLGPRPFSEKSTYEEFV

SEQ ID NO: 796258 - protein, 346 aa, Homo sapiens
GGLFGVGETAAKILKSNIDVLFDRRSWVRRIKLEIMEFVNFLKNPKQYQDLGAKIPKGAMLTGPPGTGKTLLAKATAGEATVPFITVNGSEFLEMFIGVVASKGFNSATNVVVLAGTNRPDVLDPALMRPGRFHRQIYTGPPYIKGRSSIFKVHLRPLKLDKSLNKDTLARKLALTPGFPGVHHTPGQGAPLRTVPAPGAAALHPGAALRPHVHDARGPGSRAAVLREITMGAQDDLRKVTQSAYAQVVQFGVSEKLGQVSFDFSRHGKTLVEKLYGEASAQLLDDEVRHLVSATYRCTLDLLTRCREHVEKVGQRLLEKEVLEKADMVELLGPRPFSEKSTYEEF

SEQ ID NO: 796259 - protein, 932 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSSQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 796260 - protein, 923 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTNQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 796261 - protein, 230 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIGEYQSLRYLDYDTNILVFYLLFCNI

SEQ ID NO: 796262 - protein, 253 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIGVRNCCVIFSVSSLTPVPYGGGRVDLRKKVYHHPWALLRRILYSILLS

SEQ ID NO: 796263 - protein, 104 aa, Homo sapiens
SSLPHAASAQPWGCLLGRQRAGVGTSSHLLQDRPLPDTLRVRRRVGRTLSVSHRASLSPVPGQHSGPHPMSRHRERMVASRSPYSRPPSALQPPFPPGVLSFGG

SEQ ID NO: 796264 - protein, 495 aa, Homo sapiens
TLGEAAPIPAAPVLPGTREAPMALAVAPWGRQWEEARALGRAVRMLQRLEEQCVDPRLSVSPPSLRDLLPRTAQLLREVAHSRRAAGGGGPGGPGGSGDFLLIYLANLEAKSRQVAALLPPRGRRSANDELFRAGSRLRRQLAKLAIIFSHMHAELHALFPGGKYCGHMYQLTKAPAHTFWRESCGARCVLPWAEFESLLGTCHPVEPGCTALALRTTIDLTCSGHVSIFEFDVFTRLFQPWPTLLKNWQLLAVNHPGYMAFLTYDEVQERLQACRDKPGSYIFRPSCTRLGQWAIGYVSSDGSILQTIPANKPLSQVLLEGQKDGFYLYPDGKTHNPDLTELGQAEPQQRIHVSEEQLQLYWAMDSTFELCKICAESNKDVKIEPCGHLLCSCCLAAWQHSDSQTCPFCRCEIKGWEAVSIYQFHGQATAEDSGNSSDQEGRELELGQVPLSAPPLPPRPDLPPRKPRNAQPKVRLLKGNSPPAALGPQDPAPA

SEQ ID NO: 796265 - protein, 470 aa, Homo sapiens
ASRARCESAEARALGRAVRMLQRLEEQCVDPRLSVSPPSLRDLLPRTAQLLREVAHSRRAAGGGGPGGPGGSGDFLLIYLANLEAKSRQVAALLPPRGRRSANDELFRAGSRLRRQLAKLAIIFSHMHAELHALFPGGKYCGHMYQLTKAPAHTFWRESCGARCVLPWAEFESLLGTCHPVEPGCTALALRTTIDLTCSGHVSIFEFDVFTRLFQPWPTLLKNWQLLAVNHPGYMAFLTYDEVQERLQACRDKPGSYIFRPSCTRLGQWAIGYVSSDGSILQTIPANKPLSQVLLEGQKDGFYLYPDGKTHNPDLTELGQAEPQQRIHVSEEQLQLYWAMDSTFELCKICAESNKDVKIEPCGHLLCSCCLAAWQHSDSQTCPFCRCEIKGWEAVSIYQFHGQATAEDSGNSSDQEGRELELGQVPLSAPPLPPRPDLPPRKPRNAQPKVRLLKGNSPPAALGPQDPAPA

SEQ ID NO: 796266 - protein, 174 aa, Homo sapiens
MTLKWAYLYPDGKTHNPDLTELGQAEPQQRIHVSEEQLQLYWAMDSTFELCKICAESNKDVKIEPCGHLLCSCCLAAWQHSDSQTCPFCRCEIKGWEAVSIYQFHGQATAEDSGNSSDQEGRELELGQVPLSAPPLPPRPDLPPRKPRNAQPKVRLLKGNSPPAALGPQDPAPA

SEQ ID NO: 796267 - protein, 449 aa, Homo sapiens
TLGEAAPIPAAPVLPGTREAPMALAVAPWGRQWEEARALGRAVRMLQRLEEQCVDPRLSVSPPSLRDLLPRTAQLLREVAHSRRAAGGGGPGGPGGSGDFLLIYLANLEAKSRQVAALLPPRGRRSANDELFRAGSRLRRQLAKLAIIFSHMHAELHALFPGGKYCGHMYQLTKAPAHTFWRESCGARCVLPWAEFESLLGTCHPVEPGCTALALRTTIDLTCSGHVSIFEFDVFTRLFQPWPTLLKNWQLLAVNHPGYMAFLTYDEVQERLQACRDKPGSYLYPDGKTHNPDLTELGQAEPQQRIHVSEEQLQLYWAMDSTFELCKICAESNKDVKIEPCGHLLCSCCLAAWQHSDSQTCPFCRCEIKGWEAVSIYQFHGQATAEDSGNSSDQEGRELELGQVPLSAPPLPPRPDLPPRKPRNAQPKVRLLKGNSPPAALGPQDPAPA

SEQ ID NO: 796268 - protein, 495 aa, Homo sapiens; identical to SEQ ID NO: 796264

SEQ ID NO: 796269 - protein, 256 aa, Homo sapiens
ASRARCESAEARALGRAVRMLQRLEEQCVDPRLSVSPPSLRDLLPRTAQLLREVAHSRRAAGGGGPGGPGGSGDFLLIYLANLEAKSRQVAALLPPRGRRSANDELFRAGSRLRRQLAKLAIIFSHMHAELHALFPGGKYCGHMYQLTKAPAHTFWRESCGARCVLPWAEFESLLGTCHPVEPGCTALALRTTIDLTCSGHVSIFEFDVFTRLFQPWPTLLKNWQLLAVNHPGYMAFLTYDEVQERLQACRDKPGR

SEQ ID NO: 796270 - protein, 50 aa, Homo sapiens
MSSSQQPCTINSVINPIVQMRMRRHREDKGLVLCHTARSHPAPKLVHLTS

SEQ ID NO: 796271 - protein, 94 aa, Homo sapiens
FLSRSMSNILSAHDTFMKQYPKVFLHQKPRLPKLFKQEEQRELNEGKEESQHQQPDDSNNIAVHVQRAHGGHILYRPKRATEKFEEFLAILKKL

SEQ ID NO: 796272 - protein, 185 aa, Homo sapiens
PEEMELDRAVGVLGAATLLLSFLGMAWALQAADTCPEVKMVGLEGSDKLTILRGCPGLPGAPGDKGEAGTNGKRGERGPPGPPGKAGPPGPNGAPGEPQPCLTGPRTCKDLLDRGHFLSGWHTIYLPDCRPLTVLCDMDTDGGGWTVSVGLGRGGQPGSPGGQAAHLVGEHTLEFSILLVGDSQR

SEQ ID NO: 796273 - protein, 278 aa, Homo sapiens
PEEMELDRAVGVLGAATLLLSFLGMAWALQAADTCPGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 796274 - protein, 105 aa, Homo sapiens
PEEMELDRAVGVLGAATLLLSFLGMAWALQAADTCPEVKMVGLEGSDKLTILRGCPGLPGAPGDKGEAGTNGKRGERGPPGPPGKAGPPGPNGAPGEPQPCLTGD

SEQ ID NO: 796275 - protein, 316 aa, Homo sapiens
PEEMELDRAVGVLGAATLLLSFLGMAWALQAADTCPEVKMVGLEGSDKLTILRGCPGLPGAPGDKGEAGTNGKRGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 796276 - protein, 340 aa, Homo sapiens
PEEMELDRAVGVLGAATLLLSFLGMAWALQAADTCPEVKMVGLEGSDKLTILRGCPGLPGAPGDKGEAGTNGKRGERGPPGPPGKAGPPGPNGAPGEPQPCLTGDRPPPHSSHGLWLPLAGSPGSYDAIARMKCKYEQKKMVACPFPCPLIIQGSDKYCPDNLHTLHGNFFLFIIYARRPGAQELKVGVTLGGGRARPTGCGHHSCVALGAVSLSRPQSPALFIQTPMALLLPPRPPSYCLCPAQGSCPAAIPRVPFPGPRTCKDLLDRGHFLSGWHTIYLPDCRPLTVLCDMDTDGGGWTVSVGLGRGGQPGSPGGQAAHLVGEHTLEFSILLVGDSQR

SEQ ID NO: 796277 - protein, 85 aa, Homo sapiens
GAPDRCGQHVLPRPHHPTHPHLWPSGTELWPGVPWSRWGAEELSCGLGFRGAESWPDVVRAPVVPGTREAEAGEWRGGGACSEPG

SEQ ID NO: 796278 - protein, 243 aa, Homo sapiens
MRPQGPAASPQRLRGLLLLLLLQLPAPSSASEIPKGKQKAQLRQREVVDLYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 796279 - protein, 66 aa, Homo sapiens
GGGPRSGVLQGRQELPDGQAQSGHPEEGGGRSERGASAWALKLAGGGLGAGDETGSGRGAPSGVWL

SEQ ID NO: 796280 - protein, 101 aa, Homo sapiens
SAPPSPRILPWKKPAPTAGLTEDGFKALRKTAFPFARLSFSLLLPCEEVSSAIIEEEEELLPGGGRDGTARDMPPECHQCPRTGPPMGPGYRDNLGGWGGI

SEQ ID NO: 796281 - protein, 159 aa, Homo sapiens
MVITKKVTLMVICANSWAVYHSLCMCQICIYTLGLRAQCLWVRLMCQAYVYVLGLHAQSLYIRPVCQTCVSNLCVQGLCLPRPRGWNVRYTDVLWSKNRPRRISRPAGISKFGAQVQTSTCYITCLYKFILCSEPLLPVKGIIALLMLYSGSWAWLGST

SEQ ID NO: 796282 - protein, 127 aa, Homo sapiens [sequence omitted]

SEQ ID NO: 796283 - protein, 109 aa, Homo sapiens
PEVELNHKLIKGIHQSTIDLKNELKQCIGRLQEPTPSSGDPGEHDPASTHKSTRPVKKVSKEEKKSKKPPPVPALPSKLPTFGAPEQLVDLKQAGLEAAAKATSSHPNS

SEQ ID NO: 796284 - protein, 79 aa, Homo sapiens
SRLLLLHPPFCLRDPGFCFSLIEMVESVKKLAGMDVELTAEERNLLSVTYKNVIGARRASWRIISSLEQKEGTREEKTS

SEQ ID NO: 796285 - protein, 78 aa, Homo sapiens
TVGRPWPNSQPCLLPSPGCLGLQSPLPLPAHRFGGCFGQQYCGELLQTTLAMHPGVPEGPGVSEPGPRELCAFVSGAA

SEQ ID NO: 796286 - protein, 254 aa, Homo sapiens
MPIKPVGWICGQVLKNFSGRIEGIQKAIMDLVDEFKDEFPTILRLSQSNQKREPAQKTSKIRMAIALAKINRATLIRGLNSISRSSKSVAKLLHPQLACRLLELRDISGRLLREVNAPRQPLYNIQVRKGSLFEIISFPAKTALTSIIYASYAALIYLAVCVNAVLKKVKNIFQEEESIRQNREESENCRKAFSEPVLSEPMFAEGEIKAKPYRSLPEKPDISDYPKLLANKQSNNIQVLHSVFDQSAEMNEQI

SEQ ID NO: 796287 - protein, 686 aa, Homo sapiens
MKPPFLLALVVCSVVSTNLKMVSKRNSVDGCIDWSVDLKTYMALAGEPVRVKCALFYSYIRTNYSTAQSTGLRLMWYKNKGDLEEPIIFSEVRMSKEEDSIWFHSAEAQDSGFYTCVLRNSTYCMKVSMSLTVAENESGLCYNSRIRYLEKSEVTKRKEISCPDMDDFKKSDQEPDVVWYKECKPKMWRSIIIQKGNALLIQEVQEEDGGNYTCELKYEGKLVRRTTELKVTALLTDKPPKPLFPMENQPSVIDVQLGKPLNIPCKAFFGFSGESGPMIYWMKGEKFIEELAGHIREGEIRLLKEHLGEKEVELALIFDSVVEADLANYTCHVENRNGRKHASVLLRKKDLIYKIELAGGLGAIFLLLVLLVVIYKCYNIELMLFYRQHFGADETNDDNKEYDAYLSYTKVDQDTLDCDNPEEEQFALEVLPDVLEKHYGYKLFIPERDLIPSGTYMEDLTRYVEQSRRLIIVLTPDYILRRGWSIFELESRLHNMLVSGEIKVILIECTELKGKVNCQEVESLKRSIKLLSLIKWKGSKSSKLNSKFWKHLVYEMPIKKKEMLPRCHVLDSAEQGLFGELQPIPSIAMTSTSATLVSSQADLPEFHPSDSMQIRHCCRGYKHEIPATTLPVPSLGNHHTYCNLPLTLLNGQLPLNNTLKDTQEFHRNSSLLPLSSKELSFTSDIW

SEQ ID NO: 796288 - protein, 170 aa, Homo sapiens
SDTRLHLTESLRHVQGPRKHMKCIRNPLLPPLPRQHCPLLGTAPCWPLCPHTLGLQGFSETLQFRLLGAFLSSAPVLCVGSVSPEDPQLRVTRRRPSPGWSWLCCCTRAAFPTFSRGTCSTARRTSTEHPEGSRPRPQGTPRPLQRGPVSGSLGAVVLRGHIPAEWPCSV

SEQ ID NO: 796289 - protein, 124 aa, Homo sapiens
SDTRLHLTESLRHVQGPRKHMKCIRNPLLPPLPRQHCPLLGTAPCWPLCPHTLGLQGFSETLQFRDGPGCAAAPGPPSPPFPEEPVLRPEEQVPSTPREAGPGLRGHPDPCKGVQCPGAWAQWC

SEQ ID NO: 796290 - protein, 153 aa, Homo sapiens
MSAVFGRPHACQPHAVLLRLFPSHPSGCLTPLTASLSCHLRAASGNRKTGLCPSINPFIHKFSISMSPGELQGCSQEPRSQGWSWLCCCTRAAFPTFSRGTCSTARRTSTEHPEGSRPRPQGTPRPLQRGPVSGSLGAVVLRGHIPAEWPCSV

SEQ ID NO: 796291 - protein, 188 aa, Homo sapiens
MSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSYAIDTLKAKVPIWKKEIYEESSTWKGNKECFWASNS

SEQ ID NO: 796292 - protein, 210 aa, Homo sapiens
MSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSYAIDTLKAKVPIWKKGIIRRVSLGRNTQWFGSNVITLLNTHLTGTFFGPWFPPRVWDP

SEQ ID NO: 796293 - protein, 101 aa, Homo sapiens
INAECPLRPGLGGMVPLCQVEVLYFAKSAEITGVRSETISVPQEIKALQLWKEIETRHPGLADVRNQIIFAVRQEYVELGDQLLVLQPGDEIAVIPPISGG

SEQ ID NO: 796294 - protein, 188 aa, Homo sapiens; identical to SEQ ID NO: 796291

SEQ ID NO: 796295 - protein, 188 aa, Homo sapiens; identical to SEQ ID NO: 796291

SEQ ID NO: 796296 - protein, 193 aa, Homo sapiens
MSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSYAIDTLKAKVPIWKKKYTKSHQLGKETKSAFGHPTVNHLCL

SEQ ID NO: 796297 - protein, 188 aa, Homo sapiens; identical to SEQ ID NO: 796291

SEQ ID NO: 796298 - protein, 128 aa, Homo sapiens
SPRLRLCGGIRSRCPRRDGAAVPGKGGGCACGPGCGALLDVSLPPFPSTYPALVSRTSPLAPNLAGVLGSGAPPPPPPGPSCLRALLRLPQQKSGPLRELLSAHGSKDGLVLKAPPPFMTTSFPDYSF

SEQ ID NO: 796299 - protein, 172 aa, Homo sapiens
MSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSYAIDTLKAKVPIWKKGKLRK

SEQ ID NO: 796300 - protein, 323 aa, Homo sapiens
PGRSADDELLTAGCQELVTFEDVAVYFSLEEWERLEADQRGLYQEVMQENYGILVSLGYPIPKPDLIFRLEQGEEPWVPDSPRPEEGDIVTGVYTGAWFWTDDIEDHEEEDDEDFLAEVAEEENEPPGLWSAAYGVGDVPGTWGPDDSDSAQTPEGWGPDPGGLGVLADGSEAKPFLPGREPGANLLSPWAFPAAVAPPAGRPETTCDVCGKVFPHRSRLAKHQRYHAAVKPFGCEECGKGFVYRSHLAIHQRTHTGEKPFPCPDCGKRFVYKSHLVTHRRIHTGERPYRCAFCGAGFGRRSYLVTHQRTHTGERPYPCPHCG

SEQ ID NO: 796301 - protein, 414 aa, Homo sapiens
IVVEEEEEGVAEVVQDAQVEAVAEVEVEADVEEEDVKEVLAEEECPALGTQERLSRGGDAKSPVLQEKGLQASRAPATPRDEDLEEEEEEEEDEDEDDLLTAGCQELVTFEDVAVYFSLEEWERLEADQRGLYQEVMQENYGILVSLGYPIPKPDLIFRLEQGEEPWVPDSPRPEEGDIVTGVYTGAWFWTDDIEDHEEEDDEDFLAEVAEEENEPPGLWSAAYGVGDVPGTWGPDDSDSAQTPEGWGPDPGGLGVLADGSEAKPFLPGREPGANLLSPWAFPAAVAPPAGRPETTCDVCGKVFPHRSRLAKHQRYHAAVKPFGCEECGKGFVYRSHLAIHQRTHTGEKPFPCPDCGKRFVYKSHLVTHRRIHTGERPYRCAFCGAGFGRRSYLVTHQRTHTGERPYPCPHCGR

SEQ ID NO: 796302 - protein, 114 aa, Homo sapiens
CSVVSMYRGKLTAGRGFAEEVAFGRTRMRWGFAVLPRLVTNSCAQAICLPRPPKCWDCRHEPPRPARKPLLYRPPLKCTWQLHVRKNFPAAPLNLRIFWQNEEYKRVSSSYALF

SEQ ID NO: 796303 - protein, 72 aa, Homo sapiens
TLKNWWLQQYSHDSADPGILVLLACGTISSTCGQIASYPLALVRTRMQAQGEAWAGGWGRGSLIAWAPASPK

SEQ ID NO: 796304 - protein, 53 aa, Homo sapiens
MIFTLRVSDSTGLGWGRRICTTSAQVSPVVLVGHSVCAETTGLDHHSHWKSES

SEQ ID NO: 796305 - protein, 62 aa, Homo sapiens
KAGMELLTLLYTLLFWGPLLSTLQVVLGNGQHWEVTGCRRAGLGYSLLATLSLYNHSAHSVP

SEQ ID NO: 796306 - protein, 485 aa, Homo sapiens
VPERRTLRNRRSLAALAPLTPDMLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQGPLTEPWAEDSPPDQPPPASARSSVGEGELQYASLSFQMVKPWDSRGQEATDTEYSEIKIHR

SEQ ID NO: 796307 - protein, 487 aa, Homo sapiens
VPERRTLRNRRSLAALAPLTPDMLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQILNHFIGFPTFLGLGFEFLLNLRDLCCHPDSEFYVYHFSHFRLIKNIAGEIVWSLEGKILWLLD

SEQ ID NO: 796308 - protein, 485 aa, Homo sapiens; identical to SEQ ID NO: 796306

SEQ ID NO: 796309 - protein, 476 aa, Homo sapiens
VPERRTLRNRRSLAALAPLTPDMLLLLLPLLWGRERAEGQTSKLLTMQSSVTVQEGLCVHVPCSFSYPSHGWIYPGPVVHGYWFREGANTDQDAPVATNNPARAVWEETRDRFHLLGDPHTKNCTLSIRDARRSDAGRYFFRMEKGSIKWNYKHHRLSVNVTALTHRPNILIPGTLESGCPQNLTCSVPWACEQGTPPMISWIGTSVSPLDPSTTRSSVLTLIPQPQDHGTSLTCQVTFPGASVTTNKTVHLNVSYPPQNLTMTVFQGDGTVSTVLGNGSSLSLPEGQSLRLVCAVDAVDSNPPARLSLSWRGLTLCPSQPSNPGVLELPWVHLRDAAEFTCRAQNPLGSQQVYLNVSLQSKATSGVTQGVVGGAGATALVFLSFCVIFVVVRSCRKKSARPAAGVGDTGIEDANAVRGSASQKTSSSSSSAFEQLFPHPSIPFRAEASKYYLSGTDRNYFRLHGPHSLIAAPQIC

SEQ ID NO: 796310 - protein, 76 aa, Homo sapiens
STSGLPGGKGRLLIVYKAKLKQNTSEQFETVAVKIFPYEEYASWKTEKDIFSDINLKHENILQFLTAEERKTVLGM

SEQ ID NO: 796311 - protein, 486 aa, Homo sapiens
MSAANPETPNSTISREASTQSSSAAASQGWVLPEGKIVPNTVFVGGIDARMDETEIGSCFGRYGSVKEVKIITNRTGVSKGYGFVSFVNDVDVQKIVGSQIHFHGKKLKLGPAIRKQKLCARHVQPRPLVVNPPPPPQFQNVWRNPNTETYLQPQITPNPVTQHVQAYSAYPHSPGQVITGCQLLVYNYQEYPTYPDSAFQVTTGYQLPVYNYQPFPAYPRSPFQVTAGYQLPVYNYQAFPAYPNSPFQVATGYQFPVYNYQPFPAYPSSPFQVTAGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSPFQVATGYQFPVYNYQAFPAYPNSPVQVTTGYQLPVYNYQAFPAYPNSAVQVTTGYQFHVYNYQMPPQCPVGEQRRNLWTEAYKWWYLVCLIQRRD

SEQ ID NO: 796312 - protein, 329 aa, Homo sapiens
MVTKAFVLLAIFAEASAKSCAPNKADVILVFCYPKTIITKIPECPYGWEVHQLALGGLCYNGVHEGGYYQFVIPDLSPKNKSYCGTQSEYKPPIYHFYSHIVSNDTTVIVKNQPVNYSFSCTYHSTYLVNQAAFDQRVATVHVKNGSMGTFESQLSLNFYTNAKFSIKKEAPFVLEASEIGSDLFAGVEAKGLSIRFKVVLNSCWATPSADFMYPLQWQLINKGCPTDETVLVHENGRDHRATFQFNAFRFQNIPKLSKVWLHCETFICDSEKLSCPVTCDKRKRLLRDQTGGVLVVELSLRSRGFSSLYSFSDVLHHLIMMLGICAVL

SEQ ID NO: 796313 - protein, 272 aa, Homo sapiens
MVRCLGPALLLLLLLGSASSVGGNRCVDAAEACTADARCQRLRSEYVAQCLGRAAQGGCPRARCRRALRRFFARGPPALTHALLFCPCAGPACAERRRQTFVPSCAFSGPGPAPPSCLEPLNFCERSRVCRPRLLAFQVSCTPAPSAPDGCLLDQGARCLRAYAGLVGSPGTAVTPNYVDNVSARVAPWCDCGASGNRREDCEAFRGLFTRNRCLDGAIQAFASGWPPVLLDQLNPQGDPEHSLLQVSSTGRALERRSLLSILPVLALPALL

SEQ ID NO: 796314 - protein, 299 aa, Homo sapiens
MVRCLGPALLLLLLLGSASSVGGNRCVDAAEACTADARCQRLRSEYVAQCLGRAAQGGCPRARCRRALRRFFARGPPALTHALLFCPCAGPACAERRRQTFVPSCAFSGPGPAPPSCLEPLNFCERSRVCRCARAAAGPWRGWGRGLSPAHRPPAAQASPPGLSGLVHPSAQRPRRLPAGPGRPLPARLRGPRGVPAGTAVTPNYVDNVSARVAPWCDCGASGNRREDCEAFRGLFTRNRCLDGAIQAFASGWPPVLLDQLNPQGDPEHSLLQVSSTGRALERRSLLSILPVLALPALL

SEQ ID NO: 796315 - protein, 104 aa, Homo sapiens [sequence omitted]

SEQ ID NO: 796316 - protein, 57 aa, Homo sapiens
KEKAPCQQCQSAPGDVAQSKGGNVVFTDTHVQVLVNDSKTATQFTFLLQRVSHMRPW

SEQ ID NO: 796317 - protein, 73 aa, Homo sapiens
YGVHPFSYVLLIPACFSVPFNHQKGDLEQQGHEQGGEEGLHLHLPTGFQQELMDGPGGLGGRRRVKHYRIFDS

SEQ ID NO: 796318 - protein, 111 aa, Homo sapiens
GKDTGYVCGGRTLGMCVGGGHWVCVWGEDTGYGCVGRTLGMRVWGGHWVCVCGEDTGYVCVGRTLGMCVCGGHWVWVCGEALGMCVWGGAVYVCVGRTLGVCGEALGMCVW

SEQ ID NO: 796319 - protein, 179 aa, Homo sapiens
HEADCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYS

SEQ ID NO: 796320 - protein, 178 aa, Homo sapiens
MKCNHFLPELDPDVLNGGRVQLVVRLVSREDTDLDLFSMTNGSAWSVNQRQHKHQAHRHSAGSSSGSVNGNTNIAIITIQDLLKKNVISFRDNPVQLSGGCGEVRKTEGEHFPLILRVQLQTCGNWSWTLVLRQVPWSRLNPNNWDITDSKLVPRGNLLLLKEGIPGLGGPKYIEAPL

SEQ ID NO: 796321 - protein, 69 aa, Homo sapiens
GGSVSSWAGLLGKHSSLGCGGGSRPAVWQLQAPGDLKEKLNRSPFPCLALRALVPFQTFRLSCLRGTEA

SEQ ID NO: 796322 - protein, 97 aa, Homo sapiens
KLSFLPFSHPGGLSDNKKNPGKGSKGKAASKRLRETVTLSSKCHQDTEPERRDVMCMSLAPGPGLARSGGSRNSCSPRVVAHTWNPSTLGGQDGRIT

SEQ ID NO: 796323 - protein, 335 aa, Homo sapiens
MALKWTSVLLLIHLGCYFSSGSCGKVLVWTGEYSHWMNMKTILKELVQRGHEVTVLASSASILFDPNDAFTLKLEVYPTSLTKTEFENIIMQQVKRWSDIQKDSFWLYFSQEQEILWEFHDIFRNFCKDVVSNKKVMKKLQESRFDIIFADAFFPCGELLAALLNIPFVYSLCFTPGYTIERHSGGLIFPPSYIPVVMSKLSDQMTFMERVKNMIYVLYFDFWFQMCDMKKWDQFYSEVLGRPTTLFETMGKADIWLMRNSWNFQFPHPFLPNVDFVGGLHCKPAKPLPKEMEEFVQSSGENGVVVFSLGSIISNMTAERANVIATALAKIPQKI

SEQ ID NO: 796324 - protein, 335 aa, Homo sapiens; identical to SEQ ID NO: 796323

SEQ ID NO: 796325 - protein, 103 aa, Homo sapiens [sequence omitted]

SEQ ID NO: 796326 - protein, 117 aa, Homo sapiens
PTGGRAHTVQWAEVAPRAGTWHLFPPVSGSGGTRTCRGKEAATAGQKLEAAATQQMTQLSRKTQSQGCEELGPASRGLPSFPCPALGRPHGGSPVSPARPCPALPCPALPCPALPSP

SEQ ID NO: 796327 - protein, 158 aa, Homo sapiens
VHRSTASQARRIFLSTEPNGVFYVYFFLHRHSNNLISVSFSHISPFSIQQNRHCHHGPFSMSCWVHLPDGVAAGQRRSSHPRRACPVSFKFFVEIGSHYVAQAGLKLLASSNPPSLASQSTGIIGMHHCIWPQTFCFLTVHFSRQVFTPAWVTEQDPV

SEQ ID NO: 796328 - protein, 207 aa, Homo sapiens
ATAPTSRSWCSGLGWQPVCLIALVGRSGQGAEWPLQKGCACEWFVPSTNLLFADILWAVGAGQELHVGFLLTVHAGLHGPYCQPQLWKWGLMNGVSHPRSVALVDGPGWRPTSPSRTPHSGPPVALEAQVSDLPSPICKALDTGVPGRCTEWPGHAHHSPRITQTGHRDLSTLCGDQWRKQLSFRLWASESKRGLGTRCSADTQQTA

SEQ ID NO: 796329 - protein, 31 aa, Homo sapiens
MKPAPVSCAIAPGHCSCGARLPALAFSSVTA

SEQ ID NO: 796330 - protein, 649 aa, Homo sapiens
SWESVCSFLVSGRQLQPGEPGAETEDDHSVTEGPADEGIRPRPQGSSPVYEYTTEAADFGLQEDAPGRQGSAGRRRSWWKRDSGDSRTFFRMSRPEAVQEATEVTLKTEVEAGASGYSVTGGGDQGIFVKQVLKDSSAAKLFNLREGDQLLSTTVFFENIKYEDALKILQYSEPYKVQFKIRRQLPAPQDEEWASSDAQHGPQGKEKEDTDVADGCRETPTKTLEGDGDQERLISKPRVGRGRQSQRERLSWPKFQSIKSKRGPGPQRSHSSSEAYEPRDAHDVSPTSTDTEAQLTVERQEQKAGPGSQRRRKFLNLRFRTGSGQGPSSTGQPGRGFQSGVGRAGVLEELGPWGDSLEETGAATGSRREERAEQDREVMPAQSMPLPTELGDPRLCEGTPQEGGLRAARLHGKTLEGQAQETAVAQRKPRAQPTPGMSREGEGEGLQSLEIGIARLSLRDTTEGGTQIGPPEIRVRVHDLKTPKFAFSTEKEPERERRLSTPQRGKRQDASSKAGTGLKGEEVEGAGWMPGREPTTHAEAQGDEGDGEEGLQRTRITEEQDKGREDTEGQIRMPKFKIPSLGWSPSKHTKTGREKATEDTEQGREGEATATADRREQRRTEEGLKDKEDSDSMTNTTKIQLIHDEKRLK

SEQ ID NO: 796331 - protein, 144 aa, Homo sapiens
SFKMPKVDLKGPQIDVKGPKLDLKGPKAEVTAPDGEVSLPSMEVDVQAQKAKLDGAWLEEDTEGQIRMPKFKIPSLGWSPSKHTKTGREKATEDTEQGREGEATATADRREQRRTEEGLKDKEDSDSMTNTTKIQLIHDEKRLK

SEQ ID NO: 796332 - protein, 104 aa, Homo sapiens
PARPPRAPEPGPATGRDGPPGPHRLAAAMCDCFHMVLPTWPGTPGSVSGRQLQPGEPGAETEDDHSVTEGPADEGIRPRPQGSSPVYEYTTEAADFGLQVSLLG

SEQ ID NO: 796333 - protein, 320 aa, Homo sapiens
LRGHIAWPFVWHVENTSYWLQPSLQPSSVISIMKPVRKRKTATITTRTSSQVTFPNEPARCWLLGTLWDRFEVQGLQPNGEEMTLKQFLDYFKTEHKEPALCVALRVARRVAHGVAHSVAHRGALGVSLRDTTEGGTQIGPPEIRVRVHDLKTPKFAFSTEKEPERERRLSTPQRGKRQDASSKAGTGLKGEEVEGAGWMPGREPTTHAEAQGDEGDGEEGLQRTRITEEQDKGREDTEGQIRMPKFKIPSLGWSPSKHTKTGREKATEDTEQGREGEATATADRREQRRTEEGLKDKEDSDSMTNTTKIQLIHDEKRLK

SEQ ID NO: 796334 - protein, 81 aa, Homo sapiens
IKKKRFNGLAIMAGDKGKAKGRLTRRQARERVQGAPLYKTVRSQEMYSLSGEQNRKACPMIQLPPAGSLPRHGNYRSYNSR

SEQ ID NO: 796335 - protein, 137 aa, Homo sapiens
GRSSVATIGETRKKWGPTRLHNGNLSWPLNRGLSCLHPTPLFPGAQPGAALEGERAGVTWLVLLQESPLPPLPQLPAWPPPGRPYSSAPAPAFPMRFVPGMKKASRVPMSGPRPEAPQSPRVLFWWPFRGSRKPCLG

SEQ ID NO: 796336 - protein, 70 aa, Homo sapiens
RAWGWPGHMLRVLSCRTATVWKTLCPFWGEEYQVHLPPTFHAVAFYVMDEDALSRDDVIGKVCLTRDTIA

SEQ ID NO: 796337 - protein, 206 aa, Homo sapiens
VWCFVELPPSPLPLPPQPPLQPEHPGAATAAAAAAATATSAASTASTSPPRTPRHPGRERQCCLLAPPLPQPFPSVTYPLLAALARTFSNTPASLHHLLGQPRRALGLAVRAERKASSKPLPGRRAVAAAPPAGGGGEETISRYPILRVLCRCRFCCRRSESAGSNTAAVGTVGPAGAGRRTPAEPCTLVPRSPASTCPLVPSPAL

SEQ ID NO: 796338 - protein, 206 aa, Homo sapiens; identical to SEQ ID NO: 796337

SEQ ID NO: 796339 - protein, 117 aa, Homo sapiens
MATPDVSVHMEEVVVVTTPSTVLGKGSLQAPPASSPASPLLGGYTVLASSGSTYPSTVEIHPDASSLTVLSTAAVEDGSTVFKVVSPLQLLTLPGLGTTLQNVAQARLLQHNCDSAR

SEQ ID NO: 796340 - protein, 609 aa, Homo sapiens
HVLSERRLLRLRPVCTMLRTSVLRLLGRTGASRLSLLEDFGPRYYSSGSLSAGDDACDVRAYFTTPIFYVNAAPHIGHLYSALLADALCRHRRLRGPSTAATRFSTGTDEHGLKIQQAAATAGLAPTELCDRVSEQFQQLFQEAGISCTDFIRTTEARHRVAVQHFWGVLKSRGLLYKGVYEGWYCASDECFLPEAKVTQQPGPSGDSFPVSLESGHPVSWTKEENYIFRLSQFRKPLQRWLRGNPQAITPEPFHHVVLQWLDEELPDLSVSRRSSHLHWGIPVPGDDSQTIYVWLDALVNYLTVIGYPNAEFKSWWPATSHIIGKDILKFHAIYWPAFLLGAGMSPPQRICVHSHWTVCGQKMSKSLGNVVDPRTCLNRYTVDGFRYFLLRQGVPNWDCDYYDEKVVKLLNSELADALGGLLNRCTAKRINPSETYPAFCTTCFPSEPGLVGPSVRAQAEDYALVSAVATLPKQVADHYDNFRIYKALEAVSSCVRQTNGFVQRHAPWKLNWESPVDAPWLGTVLHVALECLRVFGTLLQPVTPSLADKLLSRLGVSASERSLGELYFLPRFYGHPCPFEGRRLGPETGLLFPRLDQSRTWLVKAHRT

SEQ ID NO: 796341 - protein, 600 aa, Homo sapiens
YRRPTPRHASATRRRLLGRTGASRLSLLEDFGPRYYSSGSLSAGDDACDVRAYFTTPIFYVNAAPHIGHLYSALLADALCRHRRLRGPSTAATRFSTGTDEHGLKIQQAAATAGLAPTELCDRVSEQFQQLFQEAGISCTDFIRTTEARHRVAVQHFWGVLKSRGLLYKGVYEGWYCASDECFLPEAKVTQQPGPSGDSFPVSLESGHPVSWTKEENYIFRLSQFRKPLQRWLRGNPQAITPEPFHHVVLQWLDEELPDLSVSRRSSHLHWGIPVPGDDSQTIYVWLDALVNYLTVIGYPNAEFKSWWPATSHIIGKDILKFHAIYWPAFLLGAGMSPPQRICVHSHWTVCGQKMSKSLGNVVDPRTCLNRYTVDGFRYFLLRQGVPNWDCDYYDEKVVKLLNSELADALGGLLNRCTAKRINPSETYPAFCTTCFPSEPGLVGPSVRAQAEDYALVSAVATLPKQVADHYDNFRIYKALEAVSSCVRQTNGFVQRHAPWKLNWESPVDAPWLGTVLHVALECLRVFGTLLQPVTPSLADKLLSRLGVSASERSLGELYFLPRFYGHPCPFEGRRLGPETGLLFPRLDQSRTWLVKAHRT

SEQ ID NO: 796342 - protein, 591 aa, Homo sapiens
HVLSERRLLRLRPVCTMLRTSVLRLLGRTGASRLSLLEDFGPRYYSSGSLSAGDDACDVRAYFTTPIFYVNAAPHIGHLYSALLADALCRHRRLRGPSTAATRFSTGTDEHGLKIQQAAATAGLAPTELCDRVSEQFQQLFQEAGISCTDFIRTTEARHRVAVQHFWGVLKSRGLLYKGVYEGWYCASDECFLPEAKVTQQPGPSGDSFPVSLESGHPVSWTKEENYIFRLSQFRKPLQRWLRGNPQAITPEPFHHVVLQWLDEELPDLSVSRRSSHLHWGIPVPGDDSQTIYVWLDALVNYLTVIGYPNAEFKSWWPATSHIIGKDILKFHAIYWPAFLLGAGMSPPQRICVHSHWTVCGQKMSKSLGNVVDPRTCLNRYTVDGFRYFLLRQGVPNWDCDYYDEKVVKLLNSELADALGGLLNRCTANEPGLVGPSVRAQAEDYALVSAVATLPKQVADHYDNFRIYKALEAVSSCVRQTNGFVQRHAPWKLNWESPVDAPWLGTVLHVALECLRVFGTLLQPVTPSLADKLLSRLGVSASERSLGELYFLPRFYGHPCPFEGRRLGPETGLLFPRLDQSRTWLVKAHRT

SEQ ID NO: 796343 - protein, 73 aa, Homo sapiens
VERQDSQVDKSPCRGSNSCGDPGREVSPHVDSEKGNGINMGDLGGRGQRERGGPDPGTLQHPTYLGFTSREMT

SEQ ID NO: 796344 - protein, 290 aa, Homo sapiens
GTRIRCKSSFFKGGCVDLHRISKDSLESDSESLTQEIMCHSEFDDRIRGNGMEPDSLDEEESPRWGSLHEMEEEASGKAAQMAREQNHHTWDQGANNRQQPIEDKYSDLRYDPNWKSKKEEGQLLSVEALPESTDSSLENLPLAPLYPSQETSMELSGGKGEQKESPQSAASLLGSEFLSPNYEHGARRSKPFSELSDSDLEEKSSSLSPYVKSSSSHNEVFLPGSRGPRRRKSKQHFVEKNKLTLGLPTPKTDSYLQLHNKKRGESHPEQVILRVNSLPRDGFKTFWSQ

SEQ ID NO: 796345 - protein, 316 aa, Homo sapiens
MSKRKLIPKLSIQSPVLHTNLNVQSTHPPLKKEDLHRISKDSLESDSESLTQEIMCHSEFDDRIRGNGMEPDSLDEEESPRWGSLHEMEEEASGKAAQMAREQNHHTWDQGANNRQQPIEDKYSDLRYDPNWKSKKEEGQLLSVEALPESTDSSLENLPLAPLYPSQETSMELSGGKGEQKESPQSAASLLGSEFLSPNYEHGARRSKPFSELSDSDLEEKSSSLSPYVKSSSSHNEVFLPGSRGPRRRKSKQHFVEKNKLTLGLPTPKTDSYLQLHNKKRGESHPEQVRSGYFKMSSETLNQNLRLFAVSRYRFL

SEQ ID NO: 796346 - protein, 110 aa, Homo sapiens
AGGIPGVGTVKRPSFDFKCHPEGQLLTFRAGAGGQRRVGPYDPDLKRGFLDLPQKGIQDQLKLIRAKIANQMTSGRPQASLSSHFHAKKTQLPRTMGNIGHFIRRVQVHF

SEQ ID NO: 796347 - protein, 85 aa, Homo sapiens
QGEYQGWALSRDPALTSNATQRDNCSLSEQEQEARGECESNICTVRSPGEAKMRSRLERLCQRVPMIQTSREGSWTSHRKGFKTS

SEQ ID NO: 796348 - protein, 80 aa, Homo sapiens
QGEYQGWALSRDPALTSNATQRDNCSLSEQEQEARGECESNICTVRSPGEAKMRSRLERLCQSNCSSGCGGGSPKKTYLD

SEQ ID NO: 796349 - protein, 56 aa, Homo sapiens
MRLHATLCTRILVSVPLVEPQVMRNVGLIKRRGRTLPPAALELERLVREMPFARHI

SEQ ID NO: 796350 - protein, 107 aa, Homo sapiens
NGSGGEALYSVGSLPVSNREQQWKRETERKETDIIECIEASACSLLVLSHLILTTACSTENCPLPQKNVLVLLPRICYIMLQKVFCRFGYVEDVEMGRVSWILCLKK

SEQ ID NO: 796351 - protein, 176 aa, Homo sapiens
DSYLPSHRENEHGIVLTRDVAIKLVSLYFTKDEALPWAMRRNQHMPLESRHLFKFVNWSILLPEKYRKDYVYTEPILGGLSYSLPGLTDSRALPLLANDSQLQNLPLTYILTCQHDLIRDDGLMYVTRLRNVGVQVVHEHIEDGIHGALSFMTSPFYLRLGLRIRDMYVSWLDKNL

SEQ ID NO: 796352 - protein, 72 aa, Homo sapiens
PIESVQVGVSVQPQCPVVHGVATPDTPVLAAQLTGPAGMRVALERASRSMVHAPLITGGCRQHLSTQADIAA

SEQ ID NO: 796353 - protein, 98 aa, Homo sapiens
PKPKSFNYPLLSSPGDQFEIQLTQQLWSLIPNEDVRRFMSHVIWTLKMECSETHVQGTCAKLMSRTGLLMKLLSEQQEAKASKAEWSVDQWKTDETPS

SEQ ID NO: 796354 - protein, 73 aa, Homo sapiens
RNSGRQTLPPQLIKSSQSCGGLERGGVSGVLSFDDDSDAVPQFGKNNIYEEKMHGHRKKLENLFTNKHGIFSH

SEQ ID NO: 796355 - protein, 73 aa, Homo sapiens
ETRQVRLLPQKQWRVSASKDDTEFFLPRSPPTDDQRRWRTSSYRGQKHSQTSSPTQDSEHNGLKNGPQQSGQS

SEQ ID NO: 796356 - protein, 331 aa, Homo sapiens
MNGQSQVLPGGGHESREGINMAAAPRTVLISGCSSGIGLELAVQLAHDPKKRYQVVATMRDLGKKETLEAAAGEALGQTLTVAQLDVCSDESVAQCLSCIQGEVDVLVNNAGMGLVGPLEGLSLAAMQNVFDTNFFGAVRLVKAVLPGMKRRRQGHIVVISSVMGLQGVIFNDVYAASKFALEGFFESLAIQLLQFNIFISLVEPGPVVTEFEGKLLAQVSMAEFPGTDPETLHYFRDLYLPASRKLFCSVGQNPQDVVQAIVNVISSTRPPLRRQTNIRYSPLTTLKTVDSSGSLYVRTTHRLLFRCPRLLNLGLQCLSCGCLPTRVRPR

SEQ ID NO: 796357 - protein, 258 aa, Homo sapiens
MNGQSQVLPGGGHESREGINMAAAPRTVLISGCSSGIGLELAVQLAHDPKKRYQVVATMRDLGKKETLEAAAGEALGQTLTVAQLDVCSDESVAQCLSCIQGEVDVLVNNAGMGLVGPLEGLSLAAMQNVFDTNFFGAVRLVKAVLPGMKRRRQGHIVVISSVMGLQGVIFNDVYAASKFALEGFFESLAIQLLQFNILFLWLSSQALTLRPCTTSGTSISQPPGSCFAPWDRTHRTWFRPGPGFGEWAPWAGTHRNR

SEQ ID NO: 796358 - protein, 205 aa, Homo sapiens
GRSHFRLVTWERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVLLPSMPSGSWCRSLVAPYWVPEKVAETGRGCRGRILKRIWRLKAGHGGLCL

SEQ ID NO: 796359 - protein, 255 aa, Homo sapiens
WRCHPGHCPRSRPGAMERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLVSGSVKLNVERCSLGRLTRRGLYLAFHNPGACVALVSVRVFYQRCPETLNGLAQFPDTLPGPAGLVEVAGTCLPHARASPR

SEQ ID NO: 796360 - protein, 554 aa, Homo sapiens
ETLLQRIPSPPPGMALSSRARAFSVEALVGRPSKRKLQDPIQAEQPELREKKGGEEEEERRSSAAGKSEPLEKQPKTEPSTSASSGCGSDSGYGNSSESLEEKDIQMELQGSELWKRFHDIGTEMIITKAGRFGSAQAVHKGHTHEALNLPLWRMFPSVRVKVKGLDPGKQYHVAIDVVPVDSKRYRYVYHSSQWMVAGNTDHLCIIPRFYVHPDSPCSGETWMRQIISFDRMKLTNNEMDDKGHIILQSMHKYKPRVHVIEQGSSVDLSQIQSLPTEGVKTFSFKETEFTTVTAYQNQQITKLKIERNPFAKGFRDTGRNRGVLDGLLETYPWRPSFTLDFKTFGADTQSGSSGSSPVTSSGGAPSPLNSLLSPLCFSPMFHLPTSSLGMPCPEAYLPNVNLPLCYKICPTNFWQQQPLVLPAPERLASSNSSQSLAPLMMEVPMLSSLGVTNSKSGSSEDSSDQYLQAPNSTNQMLYGLQSPGNIFLPNSITPEALSCSFHPSYDFYRYNFSMPSRLISGSNHLKVNDDSQVSFGEGKCNHVHWYPAINHYL

SEQ ID NO: 796361 - protein, 533 aa, Homo sapiens
ETLLQRIPSPPPGMALSSRARAFSVEALVGRPSKRKLQDPIQAEQPELREKKGGEEEEERRSSAAGKSEPLEKQPKTEPSTSASSGCGSDSGYGNSSESLEEKDIQMELQGSELWKRFHDIGTEMIITKAGRRMFPSVRVKVKGLDPGKQYHVAIDVVPVDSKRYRYVYHSSQWMVAGNTDHLCIIPRFYVHPDSPCSGETWMRQIISFDRMKLTNNEMDDKGHIILQSMHKYKPRVHVIEQGSSVDLSQIQSLPTEGVKTFSFKETEFTTVTAYQNQQITKLKIERNPFAKGFRDTGRNRGVLDGLLETYPWRPSFTLDFKTFGADTQSGSSGSSPVTSSGGAPSPLNSLLSPLCFSPMFHLPTSSLGMPCPEAYLPNVNLPLCYKICPTNFWQQQPLVLPAPERLASSNSSQSLAPLMMEVPMLSSLGVTNSKSGSSEDSSDQYLQAPNSTNQMLYGLQSPGNIFLPNSITPEALSCSFHPSYDFYRYNFSMPSRLISGSNHLKVNDDSQVSFGEGKCNHVHWYPAINHYL

SEQ ID NO: 796362 - protein, 119 aa, Homo sapiens
MVHHLSEGLGCLMVEAAAMIITIHEIDTAEVRKVAQGAMAIFILVVMRTLAEKTKGIHLLWIGCTLLLLKHMVVQVMCHLQEMVGKVNLKKATKADFKPERCCFRETRQQHHSATTSRG

SEQ ID NO: 796363 - protein, 115 aa, Homo sapiens
CKKVHKAEVPSCTPTHSYESMIYLVKREKRNVSVLIVPSSRQVTHLHFDPSIIYFINLKDGMHAAYFYQNFKNGAWVVETSTFCSLWSNCNLLRGTNILSNPSIILITIALVLIF

SEQ ID NO: 796364 - protein, 158 aa, Homo sapiens
KQTKEGPYETHPQSNQPIQEKKTHTSQGSVGFPGWGALTPCSSPAQAPSTPPRPAERCPVYLSRASLSKALSLSLYNSLTLSLSLLPPPLRSLLWGSLFPPLSRLPLLCLSLYRCLSVPLVLFLHPSLPCSPSVAGGAADKTPQTPSCRREGFIQLGA

SEQ ID NO: 796365 - protein, 137 aa, Homo sapiens
LQPGWLSSHLGKLLFPKPSILAGSATEVTAGSGSPGWPAHQPTVPVQQCLSSDSSTASLAGSRPCSPARRLQATVSPPSISLGRHQGEQSAGAPRSPPDLSGAPFILPDVARPRSGPAPAPPAGLPLALCRRPGLSE

SEQ ID NO: 796366 - protein, 215 aa, Homo sapiens
GTIHNVCQEKGCHGGACTRIVCVSIESADFISFLKGCDRKSVRITGIDSIKQPAVIRRNQFSFLKGRKLVLNALAEQKLKEGHETPMDIDSDDSKAASPPLKGSVSSEASELDKKEKGICVICMDTISNKKVLPKCKHEFCAPCINKAMSYKPICPTCQTSYGIQKGNQPEGSMVFTVSRDSLPGYESFGTIVITYSMKAGIQTEEHPNPGKRYP

SEQ ID NO: 796367 - protein, 267 aa, Homo sapiens
TELLQEISEIEKRYDICSKVSEKGQKTCILFESKDRQVDLSVHAYASFIDAFQHASCQLMREVLLLKSLGKERKHLHQTKFADDFRKRHPNVHFVLNQESMTLTGLPNHLAKAKQYVLKGGGMSSLAGKKLKEGHETPMDIDSDDSKAASPPLKGSVSSEASELDKKEKGICVICMDTISNKKVLPKCKHEFCAPCINKAMSYKPICPTCQTSYGIQKGNQPEGSMVFTVSRDSLPGYESFGTIVITYSMKAGIQTEEHPNPGKRYP

SEQ ID NO: 796368 - protein, 75 aa, Homo sapiens
HCVATRRFEHYARSIQRGAQFSNSHCGAWALEMPFSLYHQHPPFLGYTVSLPFSSCSQRQALSEVRRKGDFGLQF

SEQ ID NO: 796369 - protein, 133 aa, Homo sapiens
TWDYSSPFPRPAWVCCLLCCQNSLCLNFHPAHFPGRPNCSPFSHIKTDLADNWPAAWLTNCCCSVHLGCKFSELHFTRSLSSCPHFTILGKVSMMFHWCCPLLPGSSEAGGPSPLLTSPQASCLTSLTGFHLQ

SEQ ID NO: 796370 - protein, 145 aa, Homo sapiens
NTHNRHKHKHTHKDTHRHKHTYTCTDTTHTYTNTYIHTDTHMHADTRHNTHRHTHMLLPAEQKACLLWGRGYQCITTSTLDGPPGLWHWPWHLREEWRSIPTQVFESPCWGEQGCWVTLKAPSDLASLPRADAPTSSPSVPVSTF

SEQ ID NO: 796371 - protein, 129 aa, Homo sapiens
LFEPLVEPLGSVGGPVTYQLFHYMLWTPPRPTWVGGKGLQEVGGVQGTQSSLLGPNTLTFKVPLEGSMRLSSCSPPGLCSCEGLGVPCFLLGALLVRITEKLFAVDLSASVSFGKPFYDSVALSVKWVE

SEQ ID NO: 796372 - protein, 76 aa, Homo sapiens
QGVDGPRWQEGGFLSCMSLLRVSLGRGHLRMGPAEGPPGTPSPTGQQYTVGLEWWWPQEMSVTGNQGHSQSYHVTG

SEQ ID NO: 796373 - protein, 472 aa, Homo sapiens
MNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLAREVPSINKETLTTQKGVECDGSKKILPLGIDDVSSLQHYVQNNSHDDNGYRKLVGNNPSKFVGQQLKCNACRKLFSSKSRLQSHLRRHACQKPFECHSCGRAFGEKWKLDKHQKTHAEERPYKCENCGNAYKQKSNLFQHQKMHTKEKPYQCKTCGKAFSWKSSCINHEKIHNAKKSYQCNECEKSFRQNSTLIQHKKVHTGQKPFQCTDCGKAFIYKSDLVKHQRIHTGEKPYKCSICEKAFSQKSNVIDHEKIHTGKRAYECDLCGNTFIQKKNLIQHKKIHTGEKPYECNRCGKAFFQKSNLHSHQKTHSGERTYRCSECGKTFIRKLNLSLHKKTHTGQKPYGCSECGKAFADRSYLVRHQKRIHSR

SEQ ID NO: 796374 - protein, 200 aa, Homo sapiens
RTPEEEFSVGDKLFRQQSVPAASSYDSPMPPSMEDRAPLPPVPAEKFACLSPGYYSPDYGLPSPKVDALHCPPAAVVTVTPSPEGVFSSLQAKPSPSPRAELLVPSLEGALPPDLDTSEDQQATAAIIPPEPSYLEPLDEGPFSAVITEEPVEWAHPSEQALASSLIGGTSENPVSWPVGSDLLLKSPQRFPESPKRFCP

SEQ ID NO: 796375 - protein, 129 aa, Homo sapiens
RRVIHKEKRFIWLAILQTVQEAWCQHLSLVRPSGSFYSCWKAVGSWHGLARGKEGEGKALFHKQFSLWHQAIYEGPTPMTQSPPTEHHLQHWGSHCNMRFRGDKYSNCITGRWGYRKSSHSPPMAPFST

SEQ ID NO: 796376 - protein, 126 aa, Homo sapiens
IVVTMLSCLGDFCPEGFENAVYLHQLYSISIKTVVPCLLSIVAAPFYILFYRVAEAAFAPSTLCSITKLISLLPPPCPAGASLIRQQLGKDKGRSHREVLMDQACKWSMLPLLRSTGHISWSHGHT

SEQ ID NO: 796377 - protein, 176 aa, Homo sapiens
PLQGFWTKGSSVDLSGNVLGAWGWVSLFRFPTDEENLPEPRRPSVILPCPSCSYCVFFSCPFMLQPQWPVPNMPCSQPLHLLFLLPRRLFPQLFTSLTPYHLGPSSTETLERPFLKSPPSTLHHCRKFYWVPLLLTTDMHYTFLLLSFAHVICFAWNALPHLNRNPTPVEFGNMLK

SEQ ID NO: 796378 - protein, 68 aa, Homo sapiens
KATHLPHNLCTRKFPVGLKIFTLEQLLGFHPGNVSGQLIFTGADKGQNSKSSLCSPETNAYLTASSAL

SEQ ID NO: 796379 - protein, 84 aa, Homo sapiens
GNLDRNFLYKSHILSLFSGTALLFYTEVCTSLVCKLYTGIASFLQIPLQRIFLHNMMREVEDMLTAVDSYPEITTITIKRKIKQ

SEQ ID NO: 796380 - protein, 80 aa, Homo sapiens
LTHTENPRQGDHRKSPFVHILGTRYSEHGCKFISEINACLREQLFPCYFLPPWAASSGTFQTTVTTVTVVGAGRVASFRP

SEQ ID NO: 796381 - protein, 96 aa, Homo sapiens
GAEEELRCGGAEEELRCGGAEEELRCGGGEEDLRYGGAEDGTLTSAVCSKFLPKEPGGVTHSEPSTEVLQTSYTKMSSRGMMWFKPSSIWKILWNR

SEQ ID NO: 796382 - protein, 136 aa, Homo sapiens
MLRGREDGELEEGELEDDGAEETQDTSGGPERSRKEKGEKHHSDSDEEKSHRRLKRKRKKEREKEKRRSKKRRKSKHKRHASSSDDFSDFSDDSDFSPSEKGHRKYREYSPPYAPVSDWHALLSSGAGRSSTACVS

SEQ ID NO: 796383 - protein, 85 aa, Homo sapiens
RRRPRGAAGFGAAHYRAVPNPPGRPGIAGPREVGVGAAVQCPAQATGLPCGSLHRSAYSRKSWVPQGRGRVFCLVWGPSPDTVDV

SEQ ID NO: 796384 - protein, 120 aa, Homo sapiens
MQALQQQPVFPDLLKAIPVSIHVNVILFSAILIVLTMVGTAFFMYNAFGKPFETLHGPLGLYLLSFISGSCGCLVMILFASEVKIHHLSEKIANYKEGTYVYKTQSEKYTTSFWLTKGHS

SEQ ID NO: 796385 - protein, 30 aa, Homo sapiens
MQALQQQPGYKLCETTGILSILFYGSTSNT

SEQ ID NO: 796386 - protein, 108 aa, Homo sapiens [sequence omitted]

SEQ ID NO: 796387 - protein, 106 aa, Homo sapiens [sequence omitted]

SEQ ID NO: 796388 - protein, 113 aa, Homo sapiens
AQPWRGYCVEWAQAPSPPQQGKGTFLAVDPGLTPISCPVSWIELSGLGEGRRVRHPGRPPRNKSLLALSFCQMGHGAQSVGVQERVSSLPQGDQREWIQTQIPNKSRWEQGRG

SEQ ID NO: 796389 - protein, 133 aa, Homo sapiens
PLRLPWSSALQCCRPALLQRPRVARTGMDGNVAEATVDPEVFCLCLLTSYETKHSHTASKMTIFSFNLQRTALLVANILKQTKCGQVELTSHYFPEECCVNSRSPSALISPVNGFLPSGRVPSPALPPNPTQH

SEQ ID NO: 796390 - protein, 576 aa, Homo sapiens
STLILPVAGEPGVVRALRVLIGCARHGEKLERLLRVLQAPSVSSGWTPRRTAVTSLSPVDSSVSRSFQEAIPRPGCGEAAGTAEVPPDAKQRAEAAASGEDERQRARSSHLSQPVVKSVLVYRNGDPFYAGRRVVIHEKKVSSFEVFLKEVTGGVQAPFGAVRNIYTPRTGHRIRKLDQIQSGGNYVAGGQEAFKKLNYLDIGEIKKRPMEVVNTEVKPVIHSRINVSARFRKPLQEPCTIFLIANGDLINPASRLLIPRKTLNQWDHVLQMVTEKITLRSGAVHRLYTLEGKLVESGAELENGQFYVAVGRDKFKKLPYGELLFDKSTMRRPFGQKASSLPPIVGSRKSKGSGNDRHSKSTVGSSDNSSPQPLKRKGKKEDVNSEKLTKLKQNVKLKNSQETIPNSDEGIFKAGAERSETRGAAEVQEDEDTQVEVPVDQRPAEIVDEEEDGEKANKDAEQKEDFSGMNGDLEEEGGREATDAPEQVEEILDHSEQQARPARVNGGTDEENGEELQQVNNELQLVLDKERKSQGAGSGQDEADVDPQRPPRPEVKITSPEENENNQQNKDYAAVA

SEQ ID NO: 796391 - protein, 236 aa, Homo sapiens
GPLNVFSMKMWNNWGWCGGRRRGCTKILSTKKGIQMSIKNKHLIVIPAFSHTMSQLDFDFHCVFVSIDEGIFKAGAERSETRGAAEVQEDEDTQVEVPVDQRPAEIVDEEEDGEKANKDAEQKEDFSGMNGDLEEEGGREATDAPEQVEEILDHSEQQARPARVNGGTDEENGEELQQVNNELQLVLDKERKSQGAGSGQDEADVDPQRPPRPEVKITSPEENENNQQNKDYAAVA

SEQ ID NO: 796392 - protein, 576 aa, Homo sapiens; identical to SEQ ID NO: 796390

SEQ ID NO: 796393 - protein, 236 aa, Homo sapiens; identical to SEQ ID NO: 796391

SEQ ID NO: 796394 - protein, 576 aa, Homo sapiens; identical to SEQ ID NO: 796390

SEQ ID NO: 796395 - protein, 319 aa, Homo sapiens
NNFRATILFWAAAAWAKSGKPSGEMDEVGVQKCKNALKLPVLEVLPGGGWDNLRNVDMGRVMELTYSNCRTTEDGQYIIPDEIFTIPQKQSNLEMNSEILESWANYQSSTSYSINTELSLFSKVNGKFSTEFQRMKTLQVKDQAITTRVQVRNLVYTVKINPTLELSSGFRKELLDISDRLENNQTRMATYLAELLVLNYGTHVTTSVDAGAALIQEDHLRASFLQDSQSSRSAVTASAGLAFQNTVNFKFEENYTSQNVLTKSYLSNRTNSRVQSIGGVPFYPGITLQAWQQGITNHLVAIDRSGLPLHFFINPNMLP

SEQ ID NO: 796396 - protein, 35 aa, Homo sapiens
MRKRKEEGRGRRKKRKEEGGGRRRRRKKEKKKRRK

SEQ ID NO: 796397 - protein, 95 aa, Homo sapiens
LLVVMCVCEASFCCHHFAATEEARPKRNQHREAQESPGKGREIAHSAHKATACVSFWLTKRLWLSQFELGFLCLHPRACILFLPKACSTLQGSLW

SEQ ID NO: 796398 - protein, 69 aa, Homo sapiens
LPGIPHLALTPQLGDEKDLQGTGLAKGLSPDSVHLCNHHNLRERQMLTICNNNSHLWSQPFSSPFSSCN

SEQ ID NO: 796399 - protein, 136 aa, Homo sapiens
RAPRSCLLLLRGSDGPFKPEAGSGPSCFMRFWSCCAGDRSGADSPRPRTNPATAEGLPWPTLLTALHQSLLALPSLLPCPCSRFDTWSSPHLPDLQGWPGPSTSPDPLPPSSAAEAPSSFLPPPGAFFLPRWDYRS

SEQ ID NO: 796400 - protein, 191 aa, Homo sapiens
DVLAQNLSGGQKRKLTFGIAILGDPQIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESGK

SEQ ID NO: 796401 - protein, 103 aa, Homo sapiens
DVLAQNLSGGQKRKLTFGIAILGDPQIFLLDEPTAGLDPFSRHQVWNLLKERKTDRVILFSTQFMDEADILADRKVFLSQGKLKCAGSSLFLKKKWGIGYHLR

SEQ ID NO: 796402 - protein, 102 aa, Homo sapiens
ESEAHPVAQLECSGVISAHCNLHLPGSSDSPASASQVAGITGACHQARLIFVFLVETGFCHVGQTGLELLTSGDPPTSASQSAGITGVSHRARPDLPFPSLR

SEQ ID NO: 796403 - protein, 49 aa, Homo sapiens
KQRQRFIERSKVQLRDQVPRSTFGSGLLYTGLVLGFLLLLDSSLRWAAA

SEQ ID NO: 796404 - protein, 295 aa, Homo sapiens
MSKSTKLCGKTSCPRSNIFCNLLDKIVKRPSLQFLGQWGYHCYEPRIYRSLAKILRYVDLDGFDALLTDYIAFVEKSGYRFEVSFNLDFTEICVNTILYWVFARKGNPDFVELLLKKTKDYVQDRSCNLALIWRTFTPVYCPSPLSGITPLFYVAQTRQSNIFKILLQYGILEREKNPINIVLTIVLYPSRVRVMVDRELADIHEDAKTCLVLCSRVLSVISVKEIKTQLSLGRHPIISNWFDYIPSTRYKDPCELLHLCRLTIRNQLLTNNMLPDGIFSLLIPARLQNYLNLEI

SEQ ID NO: 796405 - protein, 139 aa, Homo sapiens
MSKSTKLCGKTSCPRSNIFCNLLDKIVKRPSLQFLGQWGYHCYEPRIYRSLAKILRYVDLDGFDALLTDYIAFVEKSGYRFEVSFNLDFTEICVNTILYWVFARKGNPDFVELLLKKTKDYVQDRSCNLALIWSSDKTV

SEQ ID NO: 796406 - protein, 100 aa, Homo sapiens
CCMWLQALNIVTWRLPQHIVRSKPQEPEQQNSCHPQKPAPGTAVQIGRRSSQQWLLRTPLTQQRSPDACRSPEAALSALDMAGDTQVWPSQSLFAKLKVK

SEQ ID NO: 796407 - protein, 89 aa, Homo sapiens
PVMPVSWGCPSKTPQTRAYTRCVYFLMVLEAGVGGHSVSRVGSLEVPPWLVAATTSPHPHVVVLLCGSPSRLLTGTPVMPDQGPPNNLT

SEQ ID NO: 796408 - protein, 86 aa, Homo sapiens
TALHRPVHHPCCWYEGLQKCVSPAPTATSPQPMHMHPTTLPLLLALVNKLESCCHCLKEPLWLAPLIRVLWSVVREHLGPTNAARS

SEQ ID NO: 796409 - protein, 40 aa, Homo sapiens
MQGSQTAQPSRRPLLGRDLQPPLNSHGARWIVTESVTDLE

SEQ ID NO: 796410 - protein, 113 aa, Homo sapiens
SPRLECNAAISAHCNAARVQASAPASFLVETGFHHVGQAGLYLPTSDDPPASASQSAGVTGVSHRARPVIIFSKVPLTLKKSIVWGNPLGSPSTLCKLCSFALHNKSCCCSKK

SEQ ID NO: 796411 - protein, 122 aa, Homo sapiens
MAIPLCAGAVIIGFRSKIKNALAHFLPQGTPTPLIPILVIIETISLLIQPIALAVRLTANITAGHLLMHLIGSATLAISTINLPSTLIIFTILILLTILEIAVALIQAYVFTLLVSLYLHHT

SEQ ID NO: 796412 - protein, 87 aa, Homo sapiens
LNMCTKNSPAVCLPGTAFQPLTLGLLVLWSLHLLRTLTFLARVCWISPPGGPASLVFIRETAHTSTGGEKGCLWGLLYSFSSGKLEV

SEQ ID NO: 796413 - protein, 114 aa, Homo sapiens
HCPYLEDIELSMNLLLSPGRNILSLFTSISLSVCLRPVFLVLAAWSFFHFLQFWLLSPMTSTLYYASSQPTELITMFYLSFCTSVFNILPFPLITDINFEQALQFVLLLQPLGF

SEQ ID NO: 796414 - protein, 79 aa, Homo sapiens
CGGSSTESRSRALFPRELGVLRAFPNAHTGGTRVSPNTPGQSGGFDHREGAAELLCLLAPLPHAPHSGLQQWAQRTVWH

SEQ ID NO: 796415 - protein, 455 aa, Homo sapiens
GARPPVCTGSTMSLTVVSMACVGFFLLQGAWPLMGGQDKPFLSARPSTVVPQGGHVALQCHYRRGFNNFMLYKEDRSHVPIFHGRIFQESFIMGPVTPAHAGTYRCRGSRPHSLTGWSAPSNPLVIMVTGNHRKPSLLAHPGTLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCP

SEQ ID NO: 796416 - protein, 166 aa, Homo sapiens
FVLFCFETGSHSVAQAGLQWHDHSSLQPRLPRLKPSSHLSLPSSWDYGHVPSHIFVVVLRQGLKKTKTKPRRGHGTFVDSTEVNLLSHTERTAHTPTPVIPHCCPGTRTERRLPGGRERGNAPRSSHGQQSSHLPPHNPGVCLLVSTPGDPRPQSMHSGLKLELLP

SEQ ID NO: 796417 - protein, 119 aa, Homo sapiens
MVPLHSSLGERAKLRLKKTKTKPRRGHGTFVDSTEVNLLSHTERTAHTPTPVIPHCCPGTRTERRLPGGRERGNAPRSSHGQQSSHLPPHNPGVCLLVSTPGDPRPQSMHSGLKLELLP

SEQ ID NO: 796418 - protein, 86 aa, Homo sapiens
GGAEGAGTAAPARGPVRPANRSPCPAGFLYFLGVGGGFPAFSTTAPPPAAMWLMLIKSCIKELTAAENRSTKATSLSGSIHGLLNR

SEQ ID NO: 796419 - protein, 205 aa, Homo sapiens
MRLFAGAVLSINHNKASRGRGRMDGTTAPVTKSGAAKLVKRNFLEALKSNDFGKLKAILIQRQIDVDTVFEVEDENMVLASYKQGYWLPSYKLKSSWATGLHLSVLFGHVECLLVLLDHNATINCRPNGKTPLHVACEMANVDCVKILCDRGAKLNCYSLSGHTALHFCTTPSSILCAKQLVWRGKPFWVANIVVCLYTHGFKTL

SEQ ID NO: 796420 - protein, 371 aa, Homo sapiens
MRLFAGAVLSINHNKASRGRGRMDGTTAPVTKSGAAKLVKRNFLEALKSNDFGKLKAILIQRQIDVDTVFEVEDENMVLASYKQGYWLPSYKLKSSWATGLHLSVLFGHVECLLVLLDHNATINCRPNGKTPLHVACEMANVDCVKILCDRGAKLNCYSLSGHTALHFCTTPSSILCAKQLVWRGANVNMKTNNQDEETPLHTAAHFGLSELVAFYVEHGAIVDSVNAHMETPLAIAAYWALRFKEQEYSTEHHLVCRMLLDYKAEVNARDDDFKSPLHKAAWNCDHVLMHMMLEAGAEANLMDINGCAAIQYVLKVTSVRPAAQPEICYQLLLNHGAARIYPPQFHKVRLCPVVSRLRKIQMAALSEISK

SEQ ID NO: 796421 - protein, 448 aa, Homo sapiens
MRLFAGAVLSINHNKASRGRGRMDGTTAPVTKSGAAKLVKRNFLEALKSNDFGKLKAILIQRQIDVDTVFEVEDENMVLASYKQGYWLPSYKLKSSWATGLHLSVLFGHVECLLVLLDHNATINCRPNGKTPLHVACEMANVDCVKILCDRGAKLNCYSLSGHTALHFCTTPSSILCAKQLVWRGANVNMKTNNQDEETPLHTAAHFGLSELVAFYVEHGAIVDSVNAHMETPLAIAAYWALRFKEQEYSTEHHLVCRMLLDYKAEVNARDDDFKSPLHKAAWNCDHVLMHMMLEAGAEANLMDINGCAAIQYVLKVTSVRPAAQPEICYQLLLNHGAARIYPPQFHKVIQACHSCPKAIEVVVNAYEHIRWNTKWRRAIPDDDLEKYWDFYHSLFTVCCNSPRTLMHLSRCAIRRTLHNRCHRAIPLLSLPLSLKKYLLLEPEGIIY

SEQ ID NO: 796422 - protein, 353 aa, Homo sapiens
MRLFAGAVLSINHNKASRGRGRMDGTTAPVTKSGAAKLVKRNFLEALKSNDFGKLKAILIQRQIDVDTVFEVEDENMVLASYKQGYWLPSYKLKSSWATGLHLSVLFGHVECLLVLLDHNATINCRPNGLCDRGAKLNCYSLSGHTALHFCTTPSSILCAKQLVWRGANVNMKTNNQDEETPLHTAAHFGLSELVAFYVEHGAIVDSVNAHMETPLAIAAYWALRFKEQEYSTEHHLVCRMLLDYKAEVNARDDDFKSPLHKAAWNCDHVLMHMMLEAGAEANLMDINGCAAIQYVLKVTSVRPAAQPEICYQLLLNHGAARIYPPQFHKVRLCPVVSRLRKIQMAALSEISK

SEQ ID NO: 796423 - protein, 79 aa, Homo sapiens
QVDPEPGRIQWGALHGQQVKPLGDAQGSKGDIIDGKAALLGLWVCHHSGLETGAAAFPMLGSLWTRHEVLSARAPWLEV

SEQ ID NO: 796424 - protein, 138 aa, Homo sapiens
KKGRQPSQCLLCSGSGALDTPGDSVLHGPAFSKRSDQSYRRSRLCGLGALRRFRCNLSDFWTGFFCLTWLMYVCRRVAHGTLSACCATKPLLLQVSRSQWAAQCPSAEWRRGLPLLPSLPGRRRVSETSARVNPGPCY

SEQ ID NO: 796425 - protein, 161 aa, Homo sapiens
LGGVNKENLFSSLNYDVAAKKRKKDMLNSKTKTQYFHQEKWIYVHKGSTKERHGYCTLGKAFNRLDFSTAILDSRRFNYVVRLLELIAKSQLTSLSGIAQKNFMNILEKVVLKVLEDQQNIRLIRELLQTLYTSLCTLVQRVGKSVLVGNINMWVYRMETI

SEQ ID NO: 796426 - protein, 144 aa, Homo sapiens
ITTEPTTEVKLSPTTEKTSTQPPDPGLAITPEPTTEIGHSTALGKTTAPHPDQLQTLHRKLTEVTGPPTELEPTQDSLVQSESYIQDKALTAPEEQKASTSTNICELCTCGDEMLSCIDLNPEQRLRQVPVPEPNTHNGTFTIL

SEQ ID NO: 796427 - protein, 97 aa, Homo sapiens
RSPGILSVPKLLRLPCPFPQGPWLWWLQKWEEGMWGSLGKATFHDALPSQEERRNNLVPVLDPGLQEAEPTAGSALGPLPLWSWPYPRWPLCLRPGI

SEQ ID NO: 796428 - protein, 103 aa, Homo sapiens
MSNCNPQCWRWGLVESDGIMGANFPLQCCAHRRVLTRFGCSKVCSPCPLFLFLLFQPCKMCPFLFAFSHDCKFPDTSLVTNKCQHHAPCTAFGTVNQLNFFSL

SEQ ID NO: 796429 - protein, 106 aa, Homo sapiens
LPCPQSKLVCCLGEKHIVPLSTPVCSHQESEPARVCLSLLCRQETTKALSKGNLRSRAERFLGKRGQGPDFACYEEGSKTNMLQIKKGSLQRPVVAHTCNPSYSEG

SEQ ID NO: 796430 - protein, 352 aa, Homo sapiens
MTAESGPPPPQPEVLATVKEERARKRPLQRGKPPYSYIALIAMAIAHAPERRLTLGGIYKFITERFPFYRDNPKKWQNSIRHNLTLNDCFLKIPREAGRPGKGNYWALDPNAEDMFESGSFLRRRKRFKRSDLSTYPAYMHDAAAAAAAAAAAAAAAAIFPGAVPAARPPYPGAVYAGYAPPSLAAPPPVYYPAASPGPCRVFGLVPERPLSPELGPAPSGPGGSCAFASAGAPATTTGYQPAGCTGARPANPSAYAAAYAGPDGAYPQGAGSAIFAAAGRLAGPASPPAGGSSGGVETTVDFYGRTSPGQFGALGACYNPGGQLGGASAGAYHARHAAAYPGGIDRFVSAM

SEQ ID NO: 796431 - protein, 373 aa, Homo sapiens
MTAESGPPPPQPEVLATVKEERGETAAGAGVPGEATGRGAGGRRRKRPLQRGKPPYSYIALIAMAIAHAPERRLTLGGIYKFITERFPFYRDNPKKWQNSIRHNLTLNDCFLKIPREAGRPGKGNYWALDPNAEDMFESGSFLRRRKRFKRSDLSTYPAYMHDAAAAAAAAAAAAAAAAIFPGAVPAARPPYPGAVYAGYAPPSLAAPPPVYYPAASPGPCRVFGLVPERPLSPELGPAPSGPGGSCAFASAGAPATTTGYQPAGCTGARPANPSAYAAAYAGPDGAYPQGAGSAIFAAAGRLAGPASPPAGGSSGGVETTVDFYGRTSPGQFGALGACYNPGGQLGGASAGAYHARHAAAYPGGIDRFVSAM

SEQ ID NO: 796432 - protein, 296 aa, Homo sapiens
SGCARREVEAQVRAKGDTVAERARRGGRWLTRSGMEHLERCEWLLRGTLVRAAVRRYLPWALVASMLAGSLLKELSPLPESYLSNKRNVLNVYFVKVAWAWTFCLLLPFIALTNYHLTGKAGLVLRRLSTLLVGTAIWYICTSIFSNIEHYTGSCYQSPALEGVRKEHQSKQQCHQEGGFWHGFDISGHSFLLTFCALMIVEEMSVLHEVKTDRSHCLHTAITTLVVALGILTFIWVLMFLCTAVYFHNLSQKVFGTLFGLLSWYGTYGFWYPKAFSPGLPPQSCSLNLKQDSYKK

SEQ ID NO: 796433 - protein, 124 aa, Homo sapiens
SGCARREVEAQVRAKGDTVAERARRGGRWLTRSGMEHLERCEWLLRGTLVRAAVRRYLPWALVASMLAGSLLKELSPLPESYLSNKRNVLNVDRVSPCCPDWSRTPGAQVILLSWPPKVLGLQV

SEQ ID NO: 796434 - protein, 52 aa, Homo sapiens
MSEPAMRDVWALGPESGLEASLGWSRVWVRALSRAGDSLTAVDPGSACAPAL

SEQ ID NO: 796435 - protein, 41 aa, Homo sapiens
METEETWVPELLLALSNSQCGQRTQALKGSFIPSKLEITAR

SEQ ID NO: 796436 - protein, 38 aa, Homo sapiens
MTPGVMRAWLGRALGAARRRCWRLGHTTLNAPGSPLIC

SEQ ID NO: 796437 - protein, 119 aa, Homo sapiens
MPNCCRKHATYRETPKKRQDQGMTRNGNKPTGPPKTHCINLWGVIAREVTKDFPPRRMHQVVTQKSRMSSHGRGILPQKPKTSGATANKPESPACPMPADDDSYRETIATIRGLRTGFF

SEQ ID NO: 796438 - protein, 105 aa, Homo sapiens
EKLSKTGLRADSTNVEPEKLHDCGEGGEGETQVRQGQHGEKQIHALVDRWLCANDSEDGGIAHDGDGVETADGDGDPDVGGLKSRDVREDEVDAFLCGVSHLGHD

SEQ ID NO: 796439 - protein, 109 aa, Homo sapiens
PAPTRILSATAALVGEGWEDLSSLPHLRPPQKESPWSCRVVRGWPVSAAVVSTWRLGWERESDKHICRQRLRKPVANNCGLPRLDASVRCRNRNHGPRNFVLVQERGSH

SEQ ID NO: 796440 - protein, 115 aa, Homo sapiens
YSKTKPSGPDGFTGEFYHTLMEGIISVLYNLFQKIEADRILSNSSCGTSITLKPKPDKGITTKLQTNISNDSRCKKFSTICEKIHIPQPSGTYLRYTRLVQHLKVSECNSFTSLG

SEQ ID NO: 796441 - protein, 114 aa, Homo sapiens
LVIPSSADPSGTQLRAQHQLRASWPCPHLQISLPTSTLFLIQCALCTAVRVTLLLSFCPASPVFTSCGWLFIAFRRKHKYLSLTFEVLNTVTLSNFPGFLPAQLFLNCYSYPHA

SEQ ID NO: 796442 - protein, 104 aa, Homo sapiens
FKGVGLAPAQTLAAHPASLGKFHLLLHSPHPLFGTPISHLGPNGMWHSASSNSRWTVGVVKGARCPCLSLAERAQGPHEGSRGLETGMHHLLSGPGPEGHTQGS

SEQ ID NO: 796443 - protein, 67 aa, Homo sapiens
QDTLARKSLPTEVTVRRRREITVYRVCMCGRGGIGDRLWVNRRGPHTVPHGPAPSSSGALASLRGQA

SEQ ID NO: 796444 - protein, 75 aa, Homo sapiens
NTERKTNSMGLLAWRKPKCTFLQSYYIWVHLATSAMLPKFNPNEISHIPARCPGGKLGTMSALALKINPLDLSPK

SEQ ID NO: 796445 - protein, 120 aa, Homo sapiens
MQNAAGRETGEPREPRVPDNRVHSKCHGPRPATRRNRTAELRIRPRPRLLAGSKGTACCLASSAPSLHRDMAQMRKSCQTASQAWGGRGQRFMQEWILGASALSIRAAGMENTEKPSPRT

SEQ ID NO: 796446 - protein, 76 aa, Homo sapiens
MPVAPSNHCDNQCPHIFSKALVVSVAPSPPRDKPAPYTFTDVSSLCGLQKKCEGGKAMLFTLKRDRFSFLLFVSHC

SEQ ID NO: 796447 - protein, 82 aa, Homo sapiens
MCVYYIFKLERHVFAPKVGYMIYLRNVQVENGWQKDCSSFLVCLYQNSSLFTYILALVPFSEALFVSLTFLVWIRLKYKIHL

SEQ ID NO: 796448 - protein, 281 aa, Homo sapiens
SAARLDPQPPSSITNKWLGRRSWPQPFPLRAGGLVFWVWGRGEGEGRATPVPSPEFSTLLSAPASPGPRGALVIEMSSEGAARAARKMAPAEQLRHQPWRQARPSAILAPSNRTPPPNIPHLGRLGGGANSITPARTRPKMRRPSRTSLLAGAANSAGLAGDARLGRRSSARLGARPDAAADPRRCFEKAARRLGRGSPAAGARRRRGLGAGAGTGPGRLACPELSPPHPGPALLAAAARRCGGNGEARMKNKPRLRRLPPHPLPSPSPDAGSILPRRKKM

SEQ ID NO: 796449 - protein, 109 aa, Homo sapiens
MKLDIGIINENQRVSMSRNIESRSTSPWNYTVTWDPNRYPSEVVQAQCRNLGCINAQGKEDISMNSVPIQQETLVVRRKHQGCSVSFQLEKVLVTVGCTCVTPVIHHVQ

SEQ ID NO: 796450 - protein, 163 aa, Homo sapiens
MTVKTLHGPAMVKYLLLSILGLAFLSEAAARKIPKVGHTFFQKPESCPPVPGGSMKLDIGIINENQRVSMSRNIESRSTSPWNYTVTWDPNRYPSEVVQAQCRNLGCINAQGKEDISMNSVPIQQETLVVRRKHQGCSVSFQLEKVLVTVGCTCVTPVIHHVQ

SEQ ID NO: 796451 - protein, 73 aa, Homo sapiens
LTSTSCLSSDRRILLQPDDSLQILAPVEADVGFYTCNATNALGYDSVSIAVTLAGLCCHTVLQSHMLPPCISV

SEQ ID NO: 796452 - protein, 139 aa, Homo sapiens
KISAAQQLSASEVVTHLGQTVALASGTLSVLLHCEAIGHPRPTISWARNGEEVQFSDRILLQPDDSLQILAPVEADVGFYTCNATNALGYDSVSIAVTLAGKPLVKTSRMTVINTEKPAVTVDIGSTIKTVQGVNVTIN

SEQ ID NO: 796453 - protein, 109 aa, Homo sapiens
KSLFGATGGRGRINHRCFGRPCVLMSWDPNPVPRTLRCWRLRRASETALQSSRRAVEDQLKICGHRRDADVFELFLSKKNKRSNYSRPHQSNGPTILRQCPLPNPHLPL

SEQ ID NO: 796454 - protein, 129 aa, Homo sapiens
LQGSQKQHVEHSLCSPPCEDPTRRWPSATHKRTLTRTQSRWHPHLGLPASKTAVEDQLKICGHRRDADVFELFLSKKELTEVIDLSRFKKLKYLWLHHNKSWGVLYSSVKMDEYRELALAEWDTATKIT

SEQ ID NO: 796455 - protein, 106 aa, Homo sapiens
LQGSQKQHVEHSLCSPPCEDPTRRWPSATHKRTLTRTQSRWHPHLGLPASKTAVEDQLKICGHRRDADVFELFLSKKELTEVIDLSRFKKLKYLWLHHNKDGHDGR

SEQ ID NO: 796456 - protein, 81 aa, Homo sapiens
KSLFGATGGRGRINHRCFGRPCVLMSWDPNPVPRTLRCWRLRRASETALQSSRRAVEDQLKICGHRRDADVFELFLSKKTG

SEQ ID NO: 796457 - protein, 108 aa, Homo sapiens
KSLFGATGGRGRINHRCFGRPCVLMSWDPNPVPRTLRCWRLRRASETALQSSRRAVEDQLKICGHRRDADVFELFLSKKELTEVIDLSRFKKLKYLWLHHNKDGHDGR

SEQ ID NO: 796458 - protein, 101 aa, Homo sapiens
YFHYQIFNYGCILDSTQSITFSVDIQTHINFDSFWYTVPNTAKFHKFGSCFFFPLPTCHHPKLRISFFSLELLPWSPSCVSQSSQQANIPNVPTSLSYSPA

SEQ ID NO: 796459 - protein, 71 aa, Homo sapiens
KGTSPFGKCRDMIHKLCCLCGSKAYHLQKSTCGKCGSPAKRKRKCNWTATAKRKYHGDWLNEAPKHCILQI

SEQ ID NO: 796460 - protein, 138 aa, Homo sapiens
PCIPIVGPPEPCLGGGTGKRGLPHQEHTPHRASSAQGKGPRDAKPRPHSQLPIDLLERQSMTHKSDEKWPLPEDKCSLSPQWPLNIHTIAVLTQTPLPSFIFHTYGGRKGLCSFLLGNIWVRQWNMWMNQTIQMLSVV

SEQ ID NO: 796461 - protein, 108 aa, Homo sapiens
TPPDGPLNTTGCPTGLSTSPPATPVLAPLCPTRLPQRLQTFPSKPGHLQLYFPLNRGSVWRLLSHCGPQHSGPLSAPTPAPVSSMPFFPLFLPLSMGARLTTFLQTSA

SEQ ID NO: 796462 - protein, 204 aa, Homo sapiens
MLRKTLKESDSEELEITQETPNLVPFGDVVGCLGIHIKNCRHFMPKISLQHYANLFIRISINKAVKCTKMCSLLSKNDEKNTVIKFDEVKYFSVQVPRRYDDKRNNILLELIQYDNREKRAFLLGSVQIHLYEVIQKGCFIEEVQVLHGNIFVCRLEVEFMFSYGNFGYGFSHQLKPLQKITEPSMVMNLGTTSRKNRSRDKCF

SEQ ID NO: 796463 - protein, 67 aa, Homo sapiens
TVRKPRCSRDADRVCRAVARACVCTCACVFDARTRRRCARRGGCDSCIDPSCSEMAIKKGRDNRVVE

SEQ ID NO: 796464 - protein, 159 aa, Homo sapiens
QTKGNLILVIIEDVEESIEWKTLQKKKQQKIKEKLRIRTKAAVKIQAWWRGTLVRRTLLHAALRAWIIQCWWRMTLSRVLEKKRQAALIAYATRERAVIKLQSLVRMWRVRWRYCQVLNAIYIIQGHWQCHNCQTCALLQGHCVVTATHLQFHIEIINS

SEQ ID NO: 796465 - protein, 93 aa, Homo sapiens
AAAATTTTTAAPEELQVGLAKLVDYRPTLIIYKGDRPENSNLEEPLNIRLHKKDSERKIPHQFLRVKNTLLGNHNLLSTKRFIQQRNLTCVVA

SEQ ID NO: 796466 - protein, 96 aa, Homo sapiens
AVAQRLAQDGAHVVVSRRKQQNVDQAVATLQGEGLSMTGTVCHVGKMKDWERLVATVSCREMGTEPGGGKGSQPEPPSLLSWTALVRSNAVMLTKT

SEQ ID NO: 796467 - protein, 140 aa, Homo sapiens
MGSLGQREDLQDEDRNSAFTWKVQANNRAYNGQFKEKVILCWQRKKYKTNVIRTAKYNFYSFLPLNLYEQFHRVSNLFFLIIIILQSIPDISTLPWFSLSTPMVCLLFIRATRDLVDDMGRHKSDRAINNRPCQILMGKR

SEQ ID NO: 796468 - protein, 226 aa, Homo sapiens
MGTGPAQTPRSTRAGPEPSPAPPGPGDTGDSDVTQEGSGPAGIRGGETVIRAGMGDSPGRGAPERRHKAQPGRARKYEWRPEGPTSMGSLGQREDLQDEDRNSAFTWKVQANNRAYNGQFKEKVILCWQRKKYKTNVIRTAKYNFYSFLPLNLYEQFHRVSNLFFLIIIILQSIPDISTLPWFSLSTPMVCLLFIRATRDLVDDMGRHKSDRAINNRPCQILMGKR

SEQ ID NO: 796469 - protein, 213 aa, Homo sapiens
GGAPGRAGSSGQRATPWPRKPGTQGPEGVGWDAPTLVFQGKALESSRCARQPREERQPEDLGPPAVPWDSCPSGEEGGPRTMAAVHDLEMESMNLNMGREMKEELEEEEKMREDGGGKDRAKSKKVHRIVSKWMLPEKSRGTYLERANCFPPPVFIISISLAELAVFIYYAVWKPQKQWITLDTGILESPFIYSPEKREEAWRFISYMLVHAG

SEQ ID NO: 796470 - protein, 384 aa, Homo sapiens
GGAPGRAGSSGQRATPWPRKPGTQGPEGVGWDAPTLVFQGKALESSRCARQPREERQPEDLGPPAVPWDSCPSGEEGGPRTMAAVHDLEMESMNLNMGREMKEELEEEEKMREDGGGKDRAKSKKVHRIVSKWMLPEKSRGTYLERANCFPPPVFIISISLAELAVFIYYAVWKPQKQWITLDTGILESPFIYSPEKREEAWRFISYMLVHAGVQHILGNLCMQLVLGIPLEMVHKGLRVGLVYLAGVIAGSLASSIFDPLRYLVGASGGVYALMGGYFMNVLVNFQEMIPAFGIFRLLIIILIIVLDMGFALYRRFFVPEDGSPVSFAAHIAGGFAGMSIGYTVFSCFDKALLKDPRFWIAIAAYLACVLFAVFFNIFLSPAN

SEQ ID NO: 796471 - protein, 346 aa, Homo sapiens
GGAPGRAGSSGQRATPWPRKPGTQGPEGVGWDAPTLVFQGKALESSRCARQPREERQPEDLGPPAVPWDSCPSGEEGGPRTMAAVHDLEMESMNLNMGREMKEELEEEEKMREDGGGKDRAKSKKVHRIVSKWMLPEKSRGTYLERANCFPPPVFIISISLAELAVFIYYAVWKPQKQWITLDTGILESPFIYSPEKREEAWRFISYMLVHAGVQHILGNLCMQLVLGIPLEMVHKGLRVGLVYLAGVIAGSLASSIFDPLRYLVGASGGVYALMGGYFMNVLVNFQEMIPAFGIFRLLIIILIIVLDMGFALYRRFFVPEDGSPVSSVSFFYKIEISLLSKRVIK

SEQ ID NO: 796472 - protein, 384 aa, Homo sapiens; identical to SEQ ID NO: 796470

SEQ ID NO: 796473 - protein, 46 aa, Homo sapiens
MAAVHDLEMESMNLNMGREMKEELEEEEKMREDGGGKDRAKSKKVH

SEQ ID NO: 796474 - protein, 59 aa, Homo sapiens
QICHSHGASIHRSQRCPDLPLPRGLHPQKPEMPRSATPTGPPSTEARDAQMCHSHGASI

SEQ ID NO: 796475 - protein, 86 aa, Homo sapiens
QRETKSAVPAWGDGAQRQFCPLSHSDAKKNLKESPGLSRGTEMGSSGVLRSLSTQQPFPGSPLHTTSYQKPSAQVKLYRAHAQEVT

SEQ ID NO: 796476 - protein, 49 aa, Homo sapiens
HLGRKFTLFDAADEFPSLVLQCVSKLLQLIQGTGDVWGPLGWGWACQED

SEQ ID NO: 796477 - protein, 68 aa, Homo sapiens
MPARLPSPRSPGFPIRAGTSCFPCTGEGAGVTSADARRELQNPLPTARSRERGEPGSRLTIKKSSRTE

SEQ ID NO: 796478 - protein, 95 aa, Homo sapiens
SSFNPMFLLSIALLGACCSGPAQLQASDWDHRLLKTSFEMYVEAAKPPAFLLPARQQNPHHMDTVKAYDFTFWNCGMSPTWSCISHSWGSQGALC

SEQ ID NO: 796479 - protein, 68 aa, Homo sapiens
GREADPGTGKVEAGKMRRPGGRTSTRNMGQEYNLGDRARVCLKKKKKKKKRNTQPNPCPSPSSLFSQM

SEQ ID NO: 796480 - protein, 43 aa, Homo sapiens
MTSFSAEPMKTSLMKGNCEGMLELIQVQVGGSIRPRQTEPPSR

SEQ ID NO: 796481 - protein, 101 aa, Homo sapiens
LQAACVLSKEGTIQGSANASQVCKSANILRLYTVLKKRIVSLIPLEYCAFVLYSTKMQFSFRINLFFQTIYVLFCLIVILGEQLYYLHCCYIPKTQKTDVQ

SEQ ID NO: 796482 - protein, 106 aa, Homo sapiens
MDPTPTSLLCCFMSAVSPARTLCGARFLLSTEVVWAKRSCLNENGERCQEKEDLVLATNSICCNQSLGHPHSYTPSFPRIHLPKCPHLGKTYLPLSQRDPTPIRKP

SEQ ID NO: 796483 - protein, 93 aa, Homo sapiens
TRGRTASELPLWVLCMWGSPVLQGAAPLLLLYTVPSIKVANTTTLPLNSFLGKAKNPVGLSRSSGVRLPCITSTVEGHKLTAFSSVNKAWQYL

SEQ ID NO: 796484 - protein, 170 aa, Homo sapiens
RGLSARRLRRRTDGRTADGRTDPNPRAPGAVDLRRGRFAMSPAPAEPGASEDVRAEEGFLAIRGLALALRGFPRGCEPSACAQPSHNGDCSVLPGILQKHCCILPDRNTGRLQTIVLLDWCTKYGFGVCVIQSIAPTKPQKLPRADVPLSVRLQDTVPLLHGASRCLSLT

SEQ ID NO: 796485 - protein, 152 aa, Homo sapiens
RGLSARRLRRRTDGRTADGRTDPNPRAPGAVDLRRGRFAMSPAPAEPGASEDVRAEEGFLAIRGLALALRGFPRGCEPSACAQPSHNGDCSVLPGILQKHCCILPDRNTGNAVKRQREFRWLLSHTVLFSCLFSEKCVCWWRRMRPRRPSFS

SEQ ID NO: 796486 - protein, 110 aa, Homo sapiens
MADRRIHCPGRVLPGILQKHCCILPDRNTGPLKSTGSFLLSRGENLCHLVLAYLDSPDALEQRRSSGRQRPAVQVPHLMVHLGEPGRKPERVAVQRSAGSRKIQTAQLNP

SEQ ID NO: 796487 - protein, 122 aa, Homo sapiens
PPPSQQMTLFKSCLCQALASPPASSVPGSPPHQPRSLVCGWRVVKKLQGMARGPRNTLTPLKFLGSAYGQSHLSAPWRALACTGHAEFPEPQDWQLANFFDWTHRNNIFCIMTQNTHRENFY

SEQ ID NO: 796488 - protein, 95 aa, Homo sapiens
RCGPCWCLVPFYSRAMCCCVEMPHVCLFIRSQTRLGFCDLAKFPKPAGGITGTRPHRRWASEQGATCRPPWPLRTQPGGGGAGKGFLEAFWSDLW

SEQ ID NO: 796489 - protein, 119 aa, Homo sapiens
RKEGRKERKREKERKKRERERRKRKKKEKERKRKKKERKERKKRRKKEKERREGGREGRKEKEKDERERRKKAKKEKRKERKKKKKRREGKKEGTKEIVHKKVNHKSWYYYCSFLILHL

SEQ ID NO: 796490 - protein, 247 aa, Homo sapiens
LQLCQCGPCVGGEPCLATLPLQCSVTCGNGTQERPVLCRTADDSFGICQEERPETARTCRLGPCPRNISDPSKKSYVVQWLSRPDPDSPIRKISSKGHCQGDKSIFCRMEVLSRYCSIPGYNKLCCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 796491 - protein, 134 aa, Homo sapiens
GDERIRRCSVLCCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 796492 - protein, 92 aa, Homo sapiens
MANVTLVTGFLLMGFSNIQKLRILYGVLFLLIYLAALMSNLLIITLITLDVKLQTPMYFFLKNLSFLDVFLVSVPIPKFIVNNLTHNNSISI

SEQ ID NO: 796493 - protein, 40 aa, Homo sapiens
LPIRGILTYLWTHQFIDGTLSPMSFALDHLHKIENDLSLS

SEQ ID NO: 796494 - protein, 102 aa, Homo sapiens
NGIGAEDRAVQTPVCKGRLSAFQGGWNIWCKEYAWDMRLDSQAESRSWRFVNPGLLRCGCQDKTAHIWSFFFCLFVCLFLRLSFTLVAEAGESLEPKRRRSP

SEQ ID NO: 796495 - protein, 115 aa, Homo sapiens
PRTQARGTSVTPPGLPLVPFPSLARSPRWVGTVGCDNGSRLLFLPGGRCARIRFNQMPLFAWSPGSSPPLRSTIISLRSDYLPGMASGLAESLGSLRNERWEPSLPMFLPHALLG

SEQ ID NO: 796496 - protein, 84 aa, Homo sapiens
SPPSQPPPGPLPLLLVSLVQARVPEHENELHSGDYAPPGSSVEIAKIFQADVVPRLQEGAVIVLGSTAHAVLAAPPYSIIKTSE

SEQ ID NO: 796497 - protein, 102 aa, Homo sapiens
RHNGCKFLGDEKYPSSTIFPKQDKYKCMRRTIVKWQITKDSILKLSREKGLNVYKGKTPAHLSIATMHVVEYYLQSVGEKKVNLELHKNKIIFVRIRAYNMF

SEQ ID NO: 796498 - protein, 44 aa, Homo sapiens
MRGGKLPVLRSMQALAGGDATQKIGGVLVRHSETPVLSEGLPRS

SEQ ID NO: 796499 - protein, 437 aa, Homo sapiens
LSSHAPFRNVSRQTSRQMSLCGTPEKSSYRQLSVSDRSSIRVEEIIPAARVAIQTMEVSDFTSTVACFMRLSWAAAAGRLDLVGSSQPIKESNSLCPAGIRNRLSSSGSNCSSGSEGEPVALHAGICVRQQSVSTKDSLIAGEALSLLVTCLQLRSQQLASFYNLPCVADFIIDILLGSPSAEIRRVACDQLYTLSQTDTSAHPDVQKPNQFLLGVILTAQLPLWSPTSIMRGVNQRLLSQCMEYFDLRCQLLDDLTTSEMEQLRISPATMLEDEITWLDNFEPNRTAECETSEADNILLAGHLRLIKTLLSLCGAEKEMLGSSLIKPLLDDFLFRASRIILNSHSPAGSAAISQQDFHPKCSTANSRLAAYEVLVMLADSSPSNLQIIIKELLSMHHQPDPALTKEFDYLPPVDSRSSSGFVGLRNGGATCYMNAV

SEQ ID NO: 796500 - protein, 297 aa, Homo sapiens
GQARRVAMEEERGSALAAESALEKNVAELTVMDVYDIASLVGHEFERVIDQHGCEAIARLMPKVVRVLEILEVLVSRHHVAPELDELRLELDRLRLERMDRIEKERKHQKELELVEDVWRGEAQDLLSQIAQLQEENKQLMTNLSHKDVNFSEEEFQKHEGMSERERQVMKKLKEVVDKQRDEIRAKDRELGLKNEDVEALQQQQTRLMKINHDLRHRVTVVEAQGKALIEQKVELEADLQTKEQEMGSLRAELGKLRERLQEGAQPAMGEEEPETEPVGEEKHIRPQNKGGHGPKD

SEQ ID NO: 796501 - protein, 219 aa, Homo sapiens
GQARRVAMEEERGSALAAESALEKNVAELTVMDVYDIASLVGHEFERVIDQHGCEAIARLMPKVVRVLEILEVLVSRHHVAPELDELRLELDRLRLERMDRIEKERKHQKELELVEDVWRGEAQDLLSQIAQLQEENKQLMTNLSHKDVNFSEEEFQKHEGHTACRLPIIYGWTCETSPPFGCCESCCCEHRAQAFVWTYVFSSLRSLSPAWATQRDSQ

SEQ ID NO: 796502 - protein, 216 aa, Homo sapiens
GQARRVAMEEERGSALAAESALEKNVAELTVMDVYDIASLVGHEFERVIDQHGCEAIARLMPKVVRVLEILEVLVSRHHVAPELDELRLELDRLRLERMDRIEKERKHQKELELVEDVWRGEAQDLLSQIAQLQEENKQLMTNLSHKDVNFSEEEFQKHEGMSELTTTQTLQLALLFVLMVSHKASLMQAVLFSRQSTNPSPQHPSGAIIREHFVN

SEQ ID NO: 796503 - protein, 162 aa, Homo sapiens
VRYSLGTGPCTVLVCLSLQAFAPLVPLLKCPFLPLSGSGPYPFGLRCTLPCSSCAFASPSPARAILRFCVPVPYHSTWRNLFGAGLRSGSPPVSHHTVAHRSGTQQASENGERMNGRAGQGEMWEAPRVHSICKCSLVLATWKGAWLLTETHWSNNSYYFFF

SEQ ID NO: 796504 - protein, 108 aa, Homo sapiens
NHFAFLFFGGVGNRKGIKNPISVNKSYQHVSKFRLCHTCGWKAVATQNNSLKSKTCSSEKSDKANPCPQDPAGMPLGGRRPEFGCRNLENLEVLFHSNFFLQVVYTLP

SEQ ID NO: 796505 - protein, 101 aa, Homo sapiens
QPKCKSHSSRAAAYDLLVEMVKGSVENYRLIHNWVMAQHMQSHAPYKWDYWPHEDVRAECRFVGLTNLGATCYLASTIQQLYMIPEARQAVFTAKVEFSSL

SEQ ID NO: 796506 - protein, 168 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKATHFGSPEMPPAARSWSGSPPEAAVLRGASSLALEVARCRRL

SEQ ID NO: 796507 - protein, 275 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKVTRAPGARPLRQPHRFSASPAAHLLAPRRAVPPSIPAAFPSPPSLPSALPVLSDRGSGRRAGGEELPPASALRDADAQSCPLVYCRVVGGCGWGRGRGLTGSGAVVRGGDSQLSGDGGSWGQLGACFAPLTCRGSAPGGGREGAHPPIL

SEQ ID NO: 796508 - protein, 128 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKVL

SEQ ID NO: 796509 - protein, 48 aa, Homo sapiens
MANETQKVGAIHFPFPFTPYSIQEDFMAELYRVLEAGKIGIFESPTGT

SEQ ID NO: 796510 - protein, 104 aa, Homo sapiens
YLLVAPGKDFFKLCHQRWDYWLLVSVHLISLSLARLRSQMAALFTLSPAVRVNSSFTTFFCQDTILPFSLTFASQMGNNVLLHGDFKLLSLTISNFEQIFNILS

SEQ ID NO: 796511 - protein, 119 aa, Homo sapiens
PPSPLPRFTCYATPKETRISKPQELKGKAYLVTLICHSFCIYHKMISSQKGLNFTLLLACKQASFFPIAVQHRESSLCFYDQIKSVLTFLFLWVYFPSRYGDLNYLGNAVCLQFLCFSK

SEQ ID NO: 796512 - protein, 121 aa, Homo sapiens
SFSVVSPCSLALTANLHILLSKTKARSLPRPLVGSPCSGPALKDLTLPQAAGPHPTTIPFNPQKTLCRGVLEYLLFSILGHLWGGFSPSRWGHQKLPCFPDLNPSQCPWGCAKHLQRNVFK

SEQ ID NO: 796513 - protein, 96 aa, Homo sapiens
IKSKNYMIISIDTQKAYNIIQHPLMTKALNRLSIKVAYLKIVKAIYDKPTANVILNEQKLERFPLGTGTRQVCPLSPLLFNIVLDVLASAMKKGNK

SEQ ID NO: 796514 - protein, 98 aa, Homo sapiens
VETVSPEGRGEKRPRPDREETLVTQIDEPPSYEEALKQGLPTTRPIAPMATGVLGQHTPVTLDLPPPADTQQKPVLPGPSAVVVTRPSRASCACRQRS

SEQ ID NO: 796515 - protein, 220 aa, Homo sapiens
MASESDTEEFYDAPEDVHLGGGYPVGSPGKVGLSTFKETENTAYKVGNESPVQELKQDVSKKIIESIIEESQKVLQLEDDSLDSKGKELSDQATASPIVARTDLSNIPGLLAIDQVLPEESQKAESQNTFEETELELKKCFPSDETCEKPVDETTKLTQTSSTEQLNVLETETEVLNKEAVEVKGGGDVLEPVSSDSLSTKDFAAVEEVAPAKPPRHLTP

SEQ ID NO: 796516 - protein, 131 aa, Homo sapiens
HLSCVLWLSREGAACSDMKAAEVSQDGGLVTSTLENAQLEDGWSLKVLSALCSLVSLYEDEISDSKAQLAAITLIIGTFERMKCFSEENHEPLRTQCALAASKLLKKPDQGRAVSTCAHLFWSGRNTDKNG

SEQ ID NO: 796517 - protein, 189 aa, Homo sapiens
TTRSTTGMSCIVLGNVLHYNTEDLSINDHVDSIVNLVSILYTLSPFILLKTLELKNGGVDHSLVGRFIHLLRSEDPDQQYLILNTARKHFGAGGNQRIRFTLPPLVFAAYQLAFRYKENSKVDDKWEKKCQKIFSFAHQTISALIKAELAELPLRLFLQGALAAGEIGFENHETVAYEFMSQAFIPGEY

SEQ ID NO: 796518 - protein, 260 aa, Homo sapiens
TTRSTTGMSCIVLGNVLHYNTEDLSINDHVDSIVNLVSILYTLSPFILLKTLELKNGGVDHSLVGRFIHLLRSEDPDQQYLILNTARKHFGAGGNQRIRFTLPPLVFAAYQLAFRYKENSKVDDKWEKKCQKIFSFAHQTISALIKAELAELPLRLFLQGALAAGEIGFENHETVAYEFMSQAFSLYEDEISDSKAQLAAITLIIGTFERMKCFSEENHEPLRTQCALAASKLLKKPDQGRAVSTCAHLFWSGRNTDKNG

SEQ ID NO: 796519 - protein, 113 aa, Homo sapiens
FLKIIYLVRSIICIKPLQLNNTKTNQFMENEARIRIDISGKKVHKWLVAHENTLKIISHQGNANQICRKYHFTITRLAIIKKNRQYRVIQSHYLALALFNPKVETQMSIHRRQ

SEQ ID NO: 796520 - protein, 87 aa, Homo sapiens
EAEKDYVFDKRLRYSVRQNESNCRFRDIVVRKEEGFTHILLSSQTSDNNALTPEGAEDGNSVHKNLTAARNLLIILHTLSHLIFMTV

SEQ ID NO: 796521 - protein, 110 aa, Homo sapiens
FHPKSSADLCNNNNIIIIIMIATTRRTIMTSLPGILQYFYSWQNQAARRLIFRIFTDLTNNSAKMINAAVRLSSVIIVGTTFAQTTGPYSLCWSKKQSIFKSTLYSLIFF

SEQ ID NO: 796522 - protein, 72 aa, Homo sapiens
DFMSKTPKAMATKAKIDKWNLIKLKSFCTAKETTIRVNRQPTKWEKIFATYSSDKGLISRIFNVLISLPVNS

SEQ ID NO: 796523 - protein, 347 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTDRLSPRCPGWSTAVQSQLTATSASWVQAILP

SEQ ID NO: 796524 - protein, 353 aa, Homo sapiens
RLHAGSVGSPRRAAAEGGPRALATAAAALASVTRQQGVRMRRSSRPGSASSSRKHTPNFFSENSSMSITSEDSKGLRSAEPGPGEPEGRRARGPSCGEPALSAGVPGGTTWAGSSQQKPAPRSHNWQTACGAATVRGGASEPTGSPVVSEEPLDLLPTLDLRQEMPPPRVFKSFLSLLFQGLSVLLSLAGDVLVSMYREVCSIRFLFTAVSLLSLFLSAFWLGLLYLVSPLENEPKEMLTLSEYHERVRSQGQQLQQLQAELDKLHKEVSTVRAANSERVAKLVFQRLNEDFVRKPDYALSSVGASIDLQKTSHDYADRNTAYFWNRFQLLELRTAAHGYPGAPRVPWELLGF

SEQ ID NO: 796525 - protein, 189 aa, Homo sapiens
MPPPRVFKSFLSLLFQGLSVLLSLAGDVLVSMYREVCSIRFLFTAVSLLSLFLSAFWLGLLYLVSPLENEPKEMLTLSEYHERVRSQGQQLQQLQAELDKLHKEVSTVRAANSERVAKLVFQRLNEDFVRKPDYALSSVGASIDLQKTSHDYADRNTAYFWNLLQLLELRTAAHGYPGAPRVPWELLGF

SEQ ID NO: 796526 - protein, 224 aa, Homo sapiens
RLHAGSVGSPRRAAAEGGPRALATAAAALASVTRQQGVRMRRSSRPGSASSSRKHTPNFFSENSSMSITSEDSKGLRSAEPGPGEPEGRRARGPSCGEPALSAGVPGGTTWAGSSQQKPAPRSHNWQTACGAATVRGGASEPTGSPVVSEEPLDLLPTLDLRQEMPPPRVFKSFLSLLFQGLSVLLSLAGDVLVSMYRSEEGTLAPQEQLFGGGGEQGRNLAGA

SEQ ID NO: 796527 - protein, 248 aa, Homo sapiens
MPPPRVFKSFLSLLFQGLSVLLSLAGDVLVSMYREVCSIRFLFTAVSLLSLFLSAFWLGLLYLVSPLENEPKEMLTLSEYHERVRSQGQQLQQLQAELDKLHKEVSTVRAANSERVAKLVFQRLNEDFVRKPDYALSSVGASIDLQKTSHDYADRNTAYFWNRFSFWNYARPPTVILEPHVFPGNCWAFEGDQGQVVIQLPGRVQLSDITLQHPPPSVEHTGGANSAPRDFAVFFLLSFFTQPGPPGL

SEQ ID NO: 796528 - protein, 88 aa, Homo sapiens
PGEEQPALYPQGLQTLFLEMLFKLLGRGFVPSKLARGVMRWAQPYQLLGPQWEEQTLPPAGTPDIPALETGALNSESVSWAPSRPRTK

SEQ ID NO: 796529 - protein, 66 aa, Homo sapiens
GYIKIEGRTATFRIRGHGNYQLQWFTDSAFGLSTFPGLTQCLCEAEVSVLAVKKSNPPVKISENEE

SEQ ID NO: 796530 - protein, 136 aa, Homo sapiens
PGRRGVPGQLVGPPKGGRVCGGGSWGSGSGGGWAGGSSWWLAPGQLEPVQREGAGSAHAASGSPSESPSAFLGWSPSLSLSLCLCLFLSVSLCLLSLCSLCVSLPVSVSFSSPSLSVFLSLSLFLSVSAYLFLSLC

SEQ ID NO: 796531 - protein, 85 aa, Homo sapiens
QYPFRSHWHSKFGAGRVGRGLVYQQPPEHVHIWPGCDSIQAWPQLSSPLEWALRAERGQGVGSGTFKPVGAGDFLGPQERRDAMV

SEQ ID NO: 796532 - protein, 80 aa, Homo sapiens
MGGGPSGTKLPEEGSGSNICCTAKFAVLQPLLVIPRKTASRVDLQQTPTDLQLRDLTVRRKTNKQKRIASTSTKRPSTPA

SEQ ID NO: 796533 - protein, 101 aa, Homo sapiens
GGLSSTQCSCHCQLFAIAKPCTVKFQVLLKGTVPPTWQEGMFSLIPGMNTMHRVAIAKAKAVPHLLSVPPFPQMQHRGSSRTLSIPHDRLSGLITGASPGM

SEQ ID NO: 796534 - protein, 69 aa, Homo sapiens
LKVRGGKRGRNRHTVCSRGWSPLRQLEARSKAQVSLCLRPWDASNAPPAARGPAAGNLELCVSAGHRHK

SEQ ID NO: 796535 - protein, 69 aa, Homo sapiens; identical to SEQ ID NO: 796534

SEQ ID NO: 796536 - protein, 74 aa, Homo sapiens
EDQGSHPERLGAEDDVPHPVSEGPLWLRTVPSKPRRDGGGQVVGGDMGHMSRDQLWPERLGACPGMEGASGGGI

SEQ ID NO: 796537 - protein, 67 aa, Homo sapiens
RLISSPSSFCPPPAPNEQLSHCGFKSGAPLRLHFPLSPSTVGSAGSQWPGIDGFVIKLGGLEDGGCC

SEQ ID NO: 796538 - protein, 149 aa, Homo sapiens
MAYSLGTSAASLLGLLGLWLPRPVPLVAGAGVHLLLTFILFFWAPVPRVLQHSWILCVAAALWGVGSALNNTGLSTLLGILYKDKERQDFIFTIYHWWQAVAIFTVYLGSSLHMKAKLAMLLVTLVAAAVSYLRMEQKLRRGVAPPQPR

SEQ ID NO: 796539 - protein, 94 aa, Homo sapiens
IGGGFKAQHLGSCVNYALLNRRSEWWCIFMAAGRPRCVITSGIGGFLVSPTSRMKPWILVLTESSFKDPVKCLAINLPRADPDGSHHPKSQTTH

SEQ ID NO: 796540 - protein, 239 aa, Homo sapiens
KCNECGKAFNQQSHLSRHRRLHTGEKPYKCEACDKVFGQKSALESHKRIHTGEKPYRCQVCDTAFTWNSQLARHTRIHTGEKTYKCNECGKTFSYKSSLVWHRRLHGGEKSYKCKVCDKAFVCRSYVAKHTRIHSGMKPYKCNECSKTFSNRSSLVCHRRIHSGEKPYKCSECSKTFSQKATLLCHRRLHSGEKPYKCNDCGNTFRHWSSLVYHRRLHTGEKSYKCTVCDKAFVRNSYL

SEQ ID NO: 796541 - protein, 297 aa, Homo sapiens
EVCQLGGGEGGDGPGMGSPGMVLGLLVQIWALQEASSLSVQQGPNLLQVRQGSQATLVCQVDQATAWERLRVKWTKDGAILCQPYITNGSLSLGVCGPQGRLSWQAPSHLTLQLDPVSLNHSGAYVCWAAVEIPELEEAEGNITRLFVDPDDPTQNRNRIASFPGFLFVLLGVGSMGVAAIVWGAWFWGRRSCQQRDSGNSPGNAFYSNVLYRPRGAPKKSEDCSGEGKDQRGQSIYSTSFPQPAPRQPHLASRPCPSPRPCPSPRPGHPVSMVRVSPRPSPTQQPRPKGFPKVGEE

SEQ ID NO: 796542 - protein, 158 aa, Homo sapiens
RGVSHTASHAHSQKGRLYLFCPPALQEASSLSVQQGPNLLQVRQGSQATLVCQVDQATAWERLRVKWTKDGAILCQPYITNGSLSLGVCGPQGRLSWQAPSHLTLQLDPVSLNHSGAYVCWAAVEIPELEEAEGNITRLFVDPGTGASGEREGQWGGS

SEQ ID NO: 796543 - protein, 45 aa, Homo sapiens
LPNLAQKTVHAKPLPASQPLHGLFPCPAEFYLLFEPPSKLLFNLQ

SEQ ID NO: 796544 - protein, 132 aa, Homo sapiens
MSNFTFKRLYQLDILPEMHVTECVVKFINFCQPDRQEIVSQCCFNCIPLIMSECEQVSCLRAISISFAVNCLLTKAKPATEMDRKLSHLAPRIGPAPWIELHGDLRLACFLSPIHTPSTQGRQNSIPPRGGP

SEQ ID NO: 796545 - protein, 178 aa, Homo sapiens
MFSWVLSLAVLAASSTSWNFSANFVSCCSEENPKPNTVLALLSAHCPDVCDVLVKVIFCVIVLFMVTLALLHTDDPIAVPCDIIETGNGDRLLLAGIQFFLVLGSIWKTRARGVKMGCSPILTLLQRPLRPGLWRWLSARWASAPRAARAAAPARLAQPWRRSIPPGAGGQELWKKLF

SEQ ID NO: 796546 - protein, 178 aa, Homo sapiens; identical to SEQ ID NO: 796545

SEQ ID NO: 796547 - protein, 178 aa, Homo sapiens; identical to SEQ ID NO: 796545

SEQ ID NO: 796548 - protein, 47 aa, Homo sapiens
MIRGFEAPMAENPPPPPPPVIFCHDSPKRVLVSVIRTTPIKPTCGGG

SEQ ID NO: 796549 - protein, 114 aa, Homo sapiens
ALFSHPWNLLGFMSPLCHLHSCKLPILALLPNPLELTVSNPASTVPFLGIQDKLTLLYAFLVLLYTSIRYKLHNIALYLWLPHCKVFMYMFSSSLHFQRLAGEKCEERKRERDR

SEQ ID NO: 796550 - protein, 71 aa, Homo sapiens
RVGDTGNVKACLCTHFWRKDKRGRSQAIVPRYGKEAPCMAGFPEDAQQVGLCGMYRRSPNGESRHEPPCPA

SEQ ID NO: 796551 - protein, 175 aa, Homo sapiens
MDPVGLQLGNKNLWSCLVRLLTKDPEWLNAKMKFFLPNTDLDSRNETLDPEQRVILQLNKLHVQGSDTWQSFIHCVCMQLEVPLDLEVLLLSTFGYDDGFTSQLGAEGKSQPESQLHHGLKRPHQSCGSSPRRKQCKKQQLELAKKYLQLLRTSAQQRYRSQIPGSDVPGSLDDP

SEQ ID NO: 796552 - protein, 175 aa, Homo sapiens; identical to SEQ ID NO: 796551

SEQ ID NO: 796553 - protein, 200 aa, Homo sapiens
MDPVGLQLGNKNLWSCLVRLLTKDPEWLNAKMKFFLPNTDLDSRNETLDPEQRVILQLNKLHVQGSDTWQSFIHCVCMQLEVPLDLEVLLLSTFGYDDGFTSQLGAEGKSQPESQLHHGLKRPHQSCGSSPRRKQCKKQQLELAKKYLQLLRTSAQQRYRSQIPGSGQPHAFHQVYVPPILRRATASLDTPEGAIMGDVK

SEQ ID NO: 796554 - protein, 233 aa, Homo sapiens
MDPVGLQLGNKNLWSCLVRLLTKDPEWLNAKMKFFLPNTDLDSRNETLDPEQRVILQLNKLHVQGSDTWQSFIHCVCMQLEVPLDLEVLLLSTFGYDDGFTSQLGAEGKSQPESQLHHGLKRPHQSCGSSPRRKQCKKQQLELAKKYLQLLRTSAQQRYRSQIPGSGQPHAFHQVYVPPILRRATASYDEYVQWLHFAEGSAMLPLMLNLYVGRLGEAGAPLHPRIESEVANY

SEQ ID NO: 796555 - protein, 68 aa, Homo sapiens
GIIQSKGRRSPLTPEQLVPSPGVSLCSDLCLCSRLFRVRSGSHPCASLCLVTLQVAHGSSFLHLAFAT

SEQ ID NO: 796556 - protein, 74 aa, Homo sapiens
PHYSPMSPHRLLMSPHYSLVSPHRLLMSPLLSGVPSPPSDVPSLLSGVPSLPSDVSSPPSDVPSLLSDVPSLLS

SEQ ID NO: 796557 - protein, 130 aa, Homo sapiens
ETTVFSLLELGCLWTRASLVTSRSSRYCVWDVALAPLGRDYVVYESQALTPKAGAHGISLQCITLLNFRPRRGLAACLEHTVVLQACLCMDALPTNIRGLQRPRTLPWPATPGCPQDLHPQLTLLLGRWF

SEQ ID NO: 796558 - protein, 111 aa, Homo sapiens
GWGLIQYDWCPYKKRKLGHRQAQSDDHVKTQGRDGHLPPRHGHLPSKPWSPITKPQSSTIQATVTYHPSHGHLPAKPWPPTRQAMVTYPPSHGRLPSKERGLEQILPQSPQ

SEQ ID NO: 796559 - protein, 134 aa, Homo sapiens [sequence omitted]

SEQ ID NO: 796560 - protein, 82 aa, Homo sapiens
KMLVSAAASLQPEGSNADRQQAAGTLDRCEDLGSGDAVELLDEPTLDLPYRQTFCDPSARKLQGYQLYLFPRPESRQMENGF

SEQ ID NO: 796561 - protein, 144 aa, Homo sapiens
APLMASNLPAVISNHTIRPHSSLPTTRTFWQPMNMSHSDCPAPNTILFVPHLECAFSSDSPRRTLPGPLLCNGLSSNLSTVLPPPLPPVRWSRPGPSLHAWRAAHSGHSACPELPPQPASSAALSSQDTEEFWGLLVWHCFYDG

SEQ ID NO: 796562 - protein, 145 aa, Homo sapiens
PPPWDLTHSSPLGPTHHHGTSFTHTLWDLPTAMGTHSHPMGPAYHHGTRLPPWDLTPYGTCLPPWDPLITHALWDPPTAMGPHSRPMGPAHRHGTSLTPYGTRPPPWDLTHALWDPSTAMGPHSLIPCGTHSLPWDLSHSQLFFL

SEQ ID NO: 796563 - protein, 291 aa, Homo sapiens
MSMLPTFGFTQEQVACVCEVLQQGGNIERLGRFLWSLPACEHLHKNESVLKAKAVVAFHRGNFRELYKILESHQFSPHNHAKLQQLWLKAHYIEAEKLRGRPLGAVGKYRVRRKFPLPRSIWDGEETSYCFKEKSRSVLREWYAHNPYPSPREKRELAEATGLTTTQVSNWFKNRRQRDRAAEAKERENNENSNSNSHNPLNGSGKSVLGSSEDEKTPSGTPDHSSSSPALLLSPPPPGLPSLHSLGHPPGPSAVPVPVPGGGGADPLQHHHGLQDSILNPMSANLVDLGS

SEQ ID NO: 796564 - protein, 131 aa, Homo sapiens
MKKKQTVQGTFSKLFGKKHTTTPSTSLYATNPPWIFTQEAPEEGTGGFDGIYYGDNRFNTVSESGTATLKARPRVRPLLTFLPLNAQENHGLAVPTPSVPDDFADKEVTGTSSLVNGTSDCTGPGLYDVTQ

SEQ ID NO: 796565 - protein, 121 aa, Homo sapiens
MKKKQTVQGTFSKLFGKKHTTTPSTSLYATNPPWIFTQEAPEEGTGGFDGIYYGDNRFNTVSESGTATLKARPRVRPLLTFLPLTEFHSCCPGWSGTMASSRLPATSTSWVQAILLPQPPK

SEQ ID NO: 796566 - protein, 121 aa, Homo sapiens; identical to SEQ ID NO: 796565

SEQ ID NO: 796567 - protein, 115 aa, Homo sapiens
MKKKQTVQGTFSKLFGKKHTTTPSTSLYATNPPWIFTQEAPEEGTGGFDGIYYGDNRFNTVSESGTATLKARPRVRPLLTFLPLTEFHSCCPGWSCSEPRLHHCTPAWTTERDSI

SEQ ID NO: 796568 - protein, 103 aa, Homo sapiens
TVGSKNRALALLSWDSVLHTFTRVRDISSSHHLCRVGSINSKLVKRFRALGTLSIDTAWCRPRGFSTKGRFAHKGTFGNVEDIFGVISGWCHWHLVGRGQGCC

SEQ ID NO: 796569 - protein, 105 aa, Homo sapiens
YCRTLQASLCLTVDPADPDGVSLWHPQAKLLPFGSLYGASSCLAVASSGQAHAPWRLFQAQLLPFAACSRPRMSLTRHLQDELILPVRLQARLLPHNNLFWPNSC

SEQ ID NO: 796570 - protein, 258 aa, Homo sapiens
GDVSDVGSRTTESEAEGPLDAPRPGPAMAGPLSSCRLSARPEGGSGRGRRAERVSPSRSNEVISPEILKMRAALFCIFTYLDTRTLLHAAEVCRDWRFVARHPAVWTRVLLENARVCSKFLAMLAQWCTQAHSLTLQNLKPRQRGKKESKEEYARSTRGCLEAGLESLLKAAGGNLLILRISHCPNILTDRSLWLASCYCRALQAVTYRSATDPVGHEVIWALGAGCREIVSLQVAPLHPCQQPTRFSNRCLQMIGRC

SEQ ID NO: 796571 - protein, 116 aa, Homo sapiens
FVVLLLLFGDQILDKRNLDFFLLESLLKAAGGNLLILRISHCPNILTDRSLWLASCYCRALQAVTYRSATDPVGHEVIWALGAGCREIVSLQVAPLHPCQQPTRFSNRCLQMIGRC

SEQ ID NO: 796572 - protein, 63 aa, Homo sapiens
SASGWPSGLRRCVQVAVSPGGVGSNPTPDKRSFPVFQKRNLRRPHTKRGPQTQRTVRFTHNPK

SEQ ID NO: 796573 - protein, 115 aa, Homo sapiens
TRGSSAKEGLWKFCSSLCLFHCSVLCGELSRIGQCLNPGQRSSSQVEDDCIQLALLGFLMPTFQSNFLFPSHKDLCQATSLCHSLYVREFIQMYICTRGYTVFKVHFRIFQYAKI

SEQ ID NO: 796574 - protein, 199 aa, Homo sapiens
MSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPM

SEQ ID NO: 796575 - protein, 287 aa, Homo sapiens
MSVSNLSWLKKKSQSVDINAPGFNPLAGAGKQTPQASKPPAPKTPIIEEEQNNAANTQKHPSRRSELKRFYTIDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPM

SEQ ID NO: 796576 - protein, 203 aa, Homo sapiens
PDLVIHLPRPLKVLGLQVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPM

SEQ ID NO: 796577 - protein, 280 aa, Homo sapiens
MDYLTTFTEKSGRLLRGTANRLLGFGGGGEARQVRFEDYLREPAQGDLGCGSPPHRPPAPSSPEGPDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPM

SEQ ID NO: 796578 - protein, 52 aa, Homo sapiens
MREYGRHSRRCVPGDGVRDGLSVSVEEEGTGKTPEFPPTLCGCTAVLGRLLS

SEQ ID NO: 796579 - protein, 54 aa, Homo sapiens
MWPGLLKECMKSTQHPLQLCPSILPDYPLPLHSQPCPLCGALVLSPSTFAGEHT

SEQ ID NO: 796580 - protein, 224 aa, Homo sapiens
SLSIFKPRSTQYSQGRIHTFKPRSTQYSQGRIHTFKPRSTQYSQGRIHTFKPRSTQYSQGRIHTFKPRSTQYSQGRIHTFKPRSTQYSQGRIHTFKPRSTQYSQGRIHTFKPRSTQYSQGRIHTFKPRSTQYSQGRIHTFKPRSTQYSQGRIHTFKPRSTQYSQGRIHTFKPRSTQYSQGRIHTFKPRSTQYSQGRIHTFKPRSTQYLQGRIHTFKPRSTQYSQ

SEQ ID NO: 796581 - protein, 368 aa, Homo sapiens
MEPGQPREPQEPREPGPGAETAAAPVWEEAKIFYDNLAPKKKPKSPKPQNAVTIAVSSRALFRMDEEQQIYTEQGVEEYVRYQLEHENEPFSPGPAFPFVKALEAVNRRLRELYPDSEDVFDIVLMTNNHAQVGVRLINSINHYDLFIERFCMTGGNSPICYLKAYHTNLYLSADAEKVREAIDEGIAAATIFSPSRDVVVSQSQLRVAFDGDAVLFSDESERIVKAHGLDRFFEHEKAHENKPLAQGPLKGFLEALGRLQKKFYSKGLRLECPIRTYLVTARSAASSGARALKTLRSWGLETDEALFLAGAPKGPLLEKIRPHIFFDDQMFHVAGAQEMGTVAAHVPYGVAQTPRRTAPAKQAPSAQ

SEQ ID NO: 796582 - protein, 68 aa, Homo sapiens
MCPGDFPFIFKQFFFPLGLTNSIFDLNKSEGKLPIMGNKSSEVAKFPHTQKKRWGGGGEKNSQQKEKK

SEQ ID NO: 796583 - protein, 120 aa, Homo sapiens
RLEFFLLVVRDLAGSGVKLQTFTEIVKSGSISKSPPVAVTLPCPVKCCLLLTFLPKHHEMWRRKNTQMCPGDFPFIFKQFFFPLGLTNSIFDLNKSEGKLPIMGNKSSEVAKFPHTQKKR

SEQ ID NO: 796584 - protein, 73 aa, Homo sapiens
QEPKITVSAEPVPSELWVGESVLLVAADSLWCSLACRHRTPVPVFVVTWPSPCVLSVSVSKFPSFIRVPVILH

SEQ ID NO: 796585 - protein, 122 aa, Homo sapiens
MCSSRPPAACESLPARVSGFLQVQDGVWQARLVLGNATFRNKNRNACPHLGPWAQAHGSPHEGPAFLYPCSPPVSSPPSEEVHLTAVKIWMMTSLKLLPGDRGCCFGENSSEIPPRGLSKGF

SEQ ID NO: 796586 - protein, 132 aa, Homo sapiens
RISLHLHCSISAKSPRLSGNSGATSPQCGTSHPKAPREVFSNHSPEKPRHYDHWHPCLFPPDPPRPSHPIKPSFRSHLHPPCTLPNPENGQAGKPCQLTSPRDSGVPDFHVFTRSSSETLTSPGSTTQTRTG

SEQ ID NO: 796587 - protein, 99 aa, Homo sapiens
TVEEVERAEMKLRLDSIVIQQGRLVDQNLNKIGKDEMLQMIRHGATHVFASESEITDEDIDGILERGAKKTAEMNEKLSKMGESSLRNFTMHTEPVFEF

SEQ ID NO: 796588 - protein, 99 aa, Homo sapiens; identical to SEQ ID NO: 796587

SEQ ID NO: 796589 - protein, 95 aa, Homo sapiens
ERTSALTIGSGMVLEALGTAVRRTRKEKACRSQRKKRNCLFTDDAVVFVGNPKVSTKNTPRIMKRGRAQRLTPAIPALWEAKAGQSPEVGSSRPA

SEQ ID NO: 796590 - protein, 194 aa, Homo sapiens
PCRRKLLTGKPRGRGTSRPWPFPLKGRGNIGLGNPGRGSGHYYRWSLRVASTRPGGPPRPATSCDLWKVTWLAPQFSVFWRTCGLRVATSHAFALGASAWCKHCGGFVPQLGGHRADSAALPMRAWPQFPRQGTELPSKCNTSIVFSAIPCVTPWDPCNAGSAPKKQRKVMTLEEKVELLDMYGGVTIPIKEWP

SEQ ID NO: 796591 - protein, 106 aa, Homo sapiens
HGDWLIPVISALEEAEAGRSPELRSSRPACATWRNPISTKKNTKIGTHLWSQLLERLRWGESLEPRRQRLQSAKIASLHCSLGDRVRPCLKNQNKIIKLLPKCFTL

SEQ ID NO: 796592 - protein, 115 aa, Homo sapiens
AQLNIFPDYGTRLWTGGLDNTVRCWDLREGLQQHDFKPQIFSLGHCPNQDWLAVGMESSNVEILHVRKPEKYQLHLHESCVLSLKFASCGRWFVSTGKDNLLNAWRTPYGASIFQ

SEQ ID NO: 796593 - protein, 106 aa, Homo sapiens
PPGNTWVALEYAMGLCSGNLVLMVGYYYCCFTLLLFLLSLEMLLREASKSADLGSFGWVHFNSNPLIQFSSTTSFQRTGTHGRRQVYAVCICTETLFEGNSWRILR

SEQ ID NO: 796594 - protein, 164 aa, Homo sapiens
GAQEDPRTRNTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGSLSGILYERQHPGT

SEQ ID NO: 796595 - protein, 121 aa, Homo sapiens
MPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISREGRSSREGRS

SEQ ID NO: 796596 - protein, 260 aa, Homo sapiens
VTSAVSITAGQEGQSRTTSWRTSIQDTSASSQNHWTRSTQTTRESQEDPRQGTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSVPCRQGTTSG

SEQ ID NO: 796597 - protein, 290 aa, Homo sapiens
VTSAVSITAGQEGQSRTTSWRTSIQDTSASSQNHWTRSTQTTRESQEDPRQGTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQ

SEQ ID NO: 796598 - protein, 265 aa, Homo sapiens
VTSAVSITAGQEGQSRTTSWRTSIQDTSASSQNHWTRSTQTTRESQEDPRQGTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSDPYAGDPLESAKPRH

SEQ ID NO: 796599 - protein, 190 aa, Homo sapiens
VTSAVSITAGQEGQSRTTSWRTSIQDTSASSQNHWTRSTQTTRESQEDPRQGTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLEVPQVVPCRVP

SEQ ID NO: 796600 - protein, 157 aa, Homo sapiens
LQAFSYLEVQAMALQETPPQVTFELESLRELVLEFPGVAALEQLAQHVAAAIKKVFPRSTLGKLFRRPTPASMLARLERSSPSESTDPCSPCGGFLETYEALCDYNGFPFREEIQWDVDTIYHRQGCRHFSLGDFSHLGSRDLALSVAALSYNLWFR

SEQ ID NO: 796601 - protein, 132 aa, Homo sapiens
MGCRFRCLPQTPAVSRAWMLPSVAAGAQGFGPTLHTADASEHRVFGPCALCLACAPTEGCYWCKPGRPRQRLGGVRPWGLLRVPRCCGDSGSRASLCRDGAPVPLQGCPPFAVHSLPCWALSVAVLPAQSLV

SEQ ID NO: 796602 - protein, 120 aa, Homo sapiens
SVREALGRRGRFIRANFAESVFEGRGCEDRIFRDAFHVGRRSTPGTVSSRRLKSSSGRGASGLAAAGPNGSGAHAVLTAWLQCLAWHLLSCNWPTRGPTQASPAAGKGLCFRKCLGREPA

SEQ ID NO: 796603 - protein, 131 aa, Homo sapiens
MTHSSQDTGSCGIQEDGKLYVVDSINDLNKLNLCPAGSQHLFPLEDKIPVLGTNSGNGSRSLFFVGLLIVLIVSLALVFFVIFLIVQTGNKMDDVSRRLTAEGKDIDDLKRINNMIVKRLNQLNQLDSEQN

SEQ ID NO: 796604 - protein, 95 aa, Homo sapiens
PPATAARDDRRGLTERLRTFLLGDLRSPTDPHHLSRRTRYNTHMGQTGRGGAEGGIGVEIYIHTDLGMLKNHPQGRERWLTPVIPTLGDQGGRTT

SEQ ID NO: 796605 - protein, 97 aa, Homo sapiens
PHTFILSSSFLNLQNLLKKESTSQSPLPPFTFTPPTPHALISITISINSITSHPVYIINPAVIANAASSSRAPCLPDIQLVTKFCRSASEMSLESST

SEQ ID NO: 796606 - protein, 142 aa, Homo sapiens
EAPRSSWAGRARAGFSSAVAECGSAPSSPGSTARLFWRHSQQQRPCVFAAAQLALAWAPAAAAAGTGGLCPGLPFDPPPFPGALREPLPGSPLQAASAALAAAPAGSSSGSFSRRRRLGCCWGGSPRRAPRGEQGAAPPALG

SEQ ID NO: 796607 - protein, 119 aa, Homo sapiens
HLTLFSHSPHRGILWLLSLKPDSMELRPQTITGHIIFMKFKKRLGWARWLMPVVLALWEAKEGRSPEVRNSRPAWLTWQNPVSTKNTKIILAWWQVPIIPATREAEAGEALESGGQSFQ

SEQ ID NO: 796608 - protein, 105 aa, Homo sapiens
MVQRAELLQVLQSLEAVLIQTVYNTKMASVGLSDIAMDTTVTHATSHGRAHSVEECKVPEPAGLGTTETLARIEEKRQGLTVLAATLLVLSPQMPHWLFWLCPAR

SEQ ID NO: 796609 - protein, 105 aa, Homo sapiens; identical to SEQ ID NO: 796608

SEQ ID NO: 796610 - protein, 136 aa, Homo sapiens
MVHRGCHCRSLPQAFAEVRVGVGNTRELPRMEAACASFNLSFFSLQSSRERMAPKAGTLCCSHRPLRRLCRTSQQPLMLPSYSMASGAILSTETVSIVTLSLTWKNGTGNIPLGADVGEESSFQSPGARTWRSQLL

SEQ ID NO: 796611 - protein, 67 aa, Homo sapiens
KKRTATVNPVVKDGLPGKVTFLLRPEGIQEEKQVKSFQVDRENREPGGNGPSTPTQHDKVAAGAWHE

SEQ ID NO: 796612 - protein, 58 aa, Homo sapiens
GLCRSHAGQAKLFSQHGKLCEGSHTGRRYRHQHIHSHAHSRLWPAADGGPLCLVCPSV

SEQ ID NO: 796613 - protein, 67 aa, Homo sapiens
RADARGGTSSPAWVPAVLSLRREGYGAFKELEENHYCWWIVLLLLMERIPPPHQKQQRNSNWKITES

SEQ ID NO: 796614 - protein, 120 aa, Homo sapiens
QGVLLQSRSLQACWGRWGGMWFQKPTPPGGGLSADSLGASVCLNRTGQCLTSLTVMVPALIVSQKNYCHHPARPRDISFQLEYGQPSFENPQSANCGIRKRKLPFSKKQGGPTHLARPLL

SEQ ID NO: 796615 - protein, 101 aa, Homo sapiens
VLHSPLTSGMRVAFPDTKTYCFDAFPNIEKVSKITSPVLIIHGIEDEVIDFSHGLALYERCPKAVEPLWVEGAGHNDIELYSQYLERLRRFISQELPSQRA

SEQ ID NO: 796616 - protein, 57 aa, Homo sapiens
PSSRYTPSSRYALPPAIPSSSRYALFLPLHPLPPATPSSSRYALPPTTPSSSRYALP

SEQ ID NO: 796617 - protein, 246 aa, Homo sapiens
MGAVWSRGPQPPGRRLILVHDLLGTGLQQQEDLYHQSYECVCVLFASVPDFKEFYSESNINHEGLECLRLLNEIIADFDELLSKPKFSGVEKIKTIGSTYMAATGLNATSGQDAQQDAERSCSHLGTMVEFAVALGSKLDVINKHSFNNFRLRVGLNHGPVVAGVIGAQKPQYDIWGNTVNVASRMESTGVLGKIQVTEETAWALQSLGYTCYSRGVIKVKGKGQLCTYFLNTDLTRTGPPSATLG

SEQ ID NO: 796618 - protein, 414 aa, Homo sapiens
QRCVLKGPKMLHWLPALSGLVATRPGLRIALGTATILLVFAMAITSLFFFPTSSDCPFQAPNVSSMISNLSWELPGSLPLISVPYSMHCCTLGFLSCSLFLHMSFELKLLLLLLWLAASCSLFLHSHAWLSECLIVRLYLGPSGLQNEYYCRLDFLWKKKLRQEREETETMENLTRLLLENVLPAHVAPQFIGQNRRNEDLYHQSYECVCVLFASVPDFKEFYSESNINHEGLECLRLLNEIIADFDELLSKPKFSGVEKIKTIGSTYMAATGLNATSGQDAQQDAERSCSHLGTMVEFAVALGSKLDVINKHSFNNFRLRVGLNHGPVVAGVIGAQKPQYDIWGNTVNVASRMESTGVLGKIQVTEETAWALQSLGYTCYSRGVIKVKGKGQLCTYFLNTDLTRTGPPSATLG

SEQ ID NO: 796619 - protein, 442 aa, Homo sapiens
QRCVLKGPKMLHWLPALSGLVATRPGLRIALGTATILLVFAMAITSLFFFPTSSDCPFQAPNVSSMISNLSWELPGSLPLISVPYSMHCCTLGFLSCSLFLHMSFELKLLLLLLWLAASCSLFLHSHAWLSECLIVRLYLGPLDSRPGVLKEPKLMGAISFFIFFFTLLVLARQNEYYCRLDFLWKKKLRQEREETETMENLTRLLLENVLPAHVAPQFIGQNRRNEDLYHQSYECVCVLFASVPDFKEFYSESNINHEGLECLRLLNEIIADFDELLSKPKFSGVEKIKTIGSTYMAATGLNATSGQDAQQDAERSCSHLGTMVEFAVALGSKLDVINKHSFNNFRLRVGLNHGPVVAGVIGAQKPQYDIWGNTVNVASRMESTGVLGKIQVTEETAWALQSLGYTCYSRGVIKVKGKGQLCTYFLNTDLTRTGPPSATLG

SEQ ID NO: 796620 - protein, 308 aa, Homo sapiens
MAPGDPPQNEYYCRLDFLWKKKLRQEREETETMENLTRLLLENVLPAHVAPQFIGQNRRNEDLYHQSYECVCVLFASVPDFKEFYSESNINHEGLECLRLLNEIIADFDEPDPLTPKAWGWASGRGDGESKRDWDRTLLYIQLLSKPKFSGVEKIKTIGSTYMAATGLNATSGQDAQQDAERSCSHLGTMVEFAVALGSKLDVINKHSFNNFRLRVGLNHGPVVAGVIGAQKPQYDIWGNTVNVASRMESTGVLGKIQVTEETAWALQSLGYTCYSRGVIKVKGKGQLCTYFLNTDLTRTGPPSATLG

SEQ ID NO: 796621 - protein, 232 aa, Homo sapiens
MAPGDPPQNEYYCRLDFLWKKKLRQEREETETMENLTRLLLENVLPAHVAPQFIGQNRRNEDLYHQSYECVCVLFASVPDFKEFYSESNINHEGLECLRLLNEIIADFDEPDPLTPKAWGWASGRGDGESKRDWDRTLLYIQLLSKPKFSGVEKIKTIGSTYMAATGLNATSGQDAQQDAERSCSHLGTMVEFAVALGSKLDVINKHSFNNFRLRVGERLPLLQQSGTSSPS

SEQ ID NO: 796622 - protein, 145 aa, Homo sapiens
MERVRETGDRTLLYIQLLSKPKFSGVEKIKTIGSTYMAATGLNATSGQDAQQVRQPFLTYHPPLGSHLMGLLVGLIPVPSLAHPGGRAHCQDAERSCSHLGTMVEFAVALGSKLDVINKHSFNNFRLRVGERLPLLQQSGTSSPS

SEQ ID NO: 796623 - protein, 90 aa, Homo sapiens
SQPEIAGSTPLDESSPDSSLGQLKPSTSHHCAQEATCLFNSSSPLQFFFPTSSDCPFQAPNVSSMISNLSWELPGSLPLISVPVSVPTCP

SEQ ID NO: 796624 - protein, 241 aa, Homo sapiens
RPVTCRGRQHRALEMKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVAAPCRAVPLSPPWLTWPPHLQVGILIPTWRPWKNLRNWCSTRDSRRRTFSCPCRREAAFSNTRQPPGLHLQSPPYHQTQSPDHLDLPSSHDPSLLPPT

SEQ ID NO: 796625 - protein, 184 aa, Homo sapiens
RPVTCRGRQHRALEMKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVGRNPNTNLEALEEFKKLVQHKGLSEEDIFMPLQTGSCVLEH

SEQ ID NO: 796626 - protein, 160 aa, Homo sapiens
RPVTCRGRQHRALEMKTLFLGVTLGLAAALSFTLEEEDEGGSVHPEENPDAEDGGAWQIQRLWGQEAHIPAGAARDGRLRLLLQRPAPWGPALHGKACGCSLQGRAAVPTLAHLATSPAGRNPNTNLEALEEFKKLVQHKGLSEEDIFMPLQTGSCVLEH

SEQ ID NO: 796627 - protein, 90 aa, Homo sapiens
MPPRVVTHQRKCNFWPPAQLQGPSDSSNSNCTSRRSEAHAGWASVQRLGRAPWPLSFSLLPFTLLPLPKDCNQLPVLNPSLLEIPPVQSK

SEQ ID NO: 796628 - protein, 73 aa, Homo sapiens
GERAPQVPFIRALVPFRLMGLNQTLAECCGFFACSSSPQFAKADKADTMGLSTIFFHIHKMSALPVSDWQYPA

SEQ ID NO: 796629 - protein, 226 aa, Homo sapiens
MALSDVDVKKQIKHMMAFIEQEANEKAEEIDAKAEEEFNIEKGRLVQTQRLKIMEYYEKKEKQIEQQKKILMSTMRNQARLKVLRARNDLISDLLSEAKLRLSRIVEDPEVYQGLLDKLVLQGLLRLLEPVMIVRCRPQDLLLVEAAVQKAIPEYMTISQKHVEVQIDKEAYLAVNAAGGVEVYSGNQRIKVSNTLESRLDLSAKQKMPEIRMALFGANTNRKFFI

SEQ ID NO: 796630 - protein, 226 aa, Homo sapiens; identical to SEQ ID NO: 796629

SEQ ID NO: 796631 - protein, 226 aa, Homo sapiens; identical to SEQ ID NO: 796629

SEQ ID NO: 796632 - protein, 226 aa, Homo sapiens; identical to SEQ ID NO: 796629

SEQ ID NO: 796633 - protein, 226 aa, Homo sapiens; identical to SEQ ID NO: 796629

SEQ ID NO: 796634 - protein, 141 aa, Homo sapiens
VKAEPRRGRAITRAHGAFCLLPLGPTRLRPRESRTRAFPGMLGLPPARVRTGRRPFRCPSSFGITQCTARCAGKMCLSGFPRLWSLHSCSTKGSSSAERWIVPCCLVIPERELTVCLSRLVCLLPSLEKHAIPKTYYPEKQ

SEQ ID NO: 796635 - protein, 123 aa, Homo sapiens
VKAEPRRGRAITRAHGAFCLLPLGPTRLRPRESRTRAFPGMLGLPPARVRTGRRPFRCPSSFGITQCTARCAGKMCLSGFPRLWSLHSCSTKGSSSAERWIVPCCLVIPEKHAIPKTYYPEKQ

SEQ ID NO: 796636 - protein, 226 aa, Homo sapiens
RDPLLCVEFFRLLLETMPKVVSRSVVCSDTRDREEYDDGEKPLHVYYCLCGQVVLVLDCQLEKLPMRPRDRSRVIDAAKHAHKFCNTEDEETMYLRRPEGIELQYRKKCAKCGLLLFYQSQPKNAPVTFIVDGAVVKFGQGFGKTNIYTQKQEPPKKVMMTKRTKDMGKFSSVTVSTIDEEEEEIEAREVADSYAQNAKVIEKQLERKGMSKRPLQELAEWEPQEK

SEQ ID NO: 796637 - protein, 83 aa, Homo sapiens
ESHISQLDSISLSLKWNQPMCTQDRIQGGDPWKEHRPPALRRHGHHSRPTSSWRRAREWKKQETLFTRLRSHPRAREIGQGLW

SEQ ID NO: 796638 - protein, 69 aa, Homo sapiens
SRSDFPGATVPGLRGALPHSQRRKPLSKAWGHLESRNFRAEASHRDHPAPSLCRGEHRPEQGGDLPKGT

SEQ ID NO: 796639 - protein, 80 aa, Homo sapiens
PLGATSLGPPSRACAAPCRTPSAGSPCRRPGATLKAGISERRRATETCQKARKHLALSQSWSSGPQSSVQGTPGLFLTKL

SEQ ID NO: 796640 - protein, 123 aa, Homo sapiens
RLCACAWVVCGACMCVGCICVAWWVCVCLHVCGMCVWVVVFAGPVVAALPEVGTSAPQLPAWSSLVGGPPASPAGCMRFSMVLPVCHLPFVIALSDRQLFNILAKVAFVVFFFLKPLKLRVKK

SEQ ID NO: 796641 - protein, 260 aa, Homo sapiens
MRRARAKATFATWIGRRSFGRPDLRKSHICAPVRPLLLRMLRHVKKFEEGNFAAFLAWLPGVASKFGGATAAVMFLLLNCIVAVSQNMGIGKNGDLPRPPLRNEFRYFQRMTTTSSVEGKQNLVIMGRKTWFSIPEKNRPLKDRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 796642 - protein, 73 aa, Homo sapiens
NCSSRKSGPTLWPPSGRHRQQQAGQASPQDPVWHACATPCVALPCHGSGRQALAAKGMVDLSSGPLEACVDVS

SEQ ID NO: 796643 - protein, 101 aa, Homo sapiens
QKVCTGCRSKLKPYFLKETCGGHPVFKALSKHALSHKTIHTSSVTLFTLFCFIVFRALTLPCLFFTRHSFMRTERLLVLFTSVSPVPRTVYRTQIAPQNFN

SEQ ID NO: 796644 - protein, 120 aa, Homo sapiens
QNRKGHLPEAPDLENQLHNPRNFQGNYISYIDGNVWKVYSWTEKLILRENNLTELHKDSFEGLLSLQYLDLSCNKIQSIERHTFEPLPFLKFINLSCNVITELSFGTFQAWHEMQFLHKL

SEQ ID NO: 796645 - protein, 45 aa, Homo sapiens
MYMEVPTDVSGVVCRPSTRFQGFEERSCFRKRQNNSDNSSGILEV

SEQ ID NO: 796646 - protein, 96 aa, Homo sapiens
ATVCRTPHFSTSHLNRHLLNRPVPTCCHGNEYHPATMLYTGWAGQARRLQVSSKSRFGFLILRHLRSGKVISFPWKPFSLHFISLFLTPKPQVAEH

SEQ ID NO: 796647 - protein, 192 aa, Homo sapiens
TNHLNQVADMNLVICVLLLSIWKNNCMTTNQTNGSSTTGDKPVESMQTKLNYLRRNLLILVGIIIMVFVFICFCYLHYNCLSDDASKAGMVKKKGIAAKSSKTSFSEAKTASQCSPETQPMLSTADKSSDSSSPERASAQSSTEKLIRPSSLQKPSIPNSAGKLTRPSYPKRSFQVIMLKKIKQVISPGKGT

SEQ ID NO: 796648 - protein, 72 aa, Homo sapiens
NALIEAGAHMDATNAFKKTAYTLLEEKLLARGTMQPFSYVTLQCLAAQALGKNKIPYKGFIPEDLEAFIELH

SEQ ID NO: 796649 - protein, 66 aa, Homo sapiens
METIDGKVRLQMLGEPGLGAEKGLQLGMPGTLLPLLNPTQGRFLAPPFSPPRSSPESPTESVGYRA

SEQ ID NO: 796650 - protein, 570 aa, Homo sapiens
YAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFEANIILLNGS

SEQ ID NO: 796651 - protein, 448 aa, Homo sapiens
YAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQER

SEQ ID NO: 796652 - protein, 211 aa, Homo sapiens
YAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLG

SEQ ID NO: 796653 - protein, 367 aa, Homo sapiens
AFAKTLSKNLQKKGKLQKLGLKKKERRNMVKLHLCPKLKKINFREKKINKKVVLKNVEVLPIKRLRKNLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFEANTSS

SEQ ID NO: 796654 - protein, 219 aa, Homo sapiens
MGIEGGLQPHNTVHWAPRLSLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFEANTSS

SEQ ID NO: 796655 - protein, 66 aa, Homo sapiens
RVCASGRRGSRGLRLQPAAERGQAAETGELFAFPGSHFYMRRNPTHSYSVRLPRKGCSAVAALVRQ

SEQ ID NO: 796656 - protein, 187 aa, Homo sapiens
ASAPPAAAAPGASACSRRRNEGRRLRQASYLHSPAVIFICGGNEVVSGAPSVAEPDIQIALPAPPAPARWSREPQAARALHRIAALPRDRARLLVLPRAFVSVSFSFPSSFVSGQTQPQKPATLPRPTARDPSRREKPNTQLFCQAAEKRLFGSCSPGEAMRRKGGRTCLEWLKEGSEHPRSWGWFS

SEQ ID NO: 796657 - protein, 89 aa, Homo sapiens
FEAKQPFTPLLKIPVNEVRTGPFQSASHFQGGTVVAFQCRSAQERRPNSPPALTFAHHTSQLQLAITVVPGTVAATSEGRHFSKHLFLG

SEQ ID NO: 796658 - protein, 84 aa, Homo sapiens
PSPPELRWSQRDRSRGFAWTAFLTRAESRTQYSVTFCPSKNVSHFKKMRVPTLPCPAVPQSLSPTLKPWEGHTPFDRCRLNTAD

SEQ ID NO: 796659 - protein, 108 aa, Homo sapiens
MSFWHMYVTHCIPASRPLHCPQMLPQLCDHAVSQPGKLEAGIKTRQTGRRCIRSLGPDAVGPLPPCMPVTWNTRVVPRTMRTGEQLFPLSDYQALVGGQTGRRRLSLP

SEQ ID NO: 796660 - protein, 342 aa, Homo sapiens
MQAVDNLTSAPGNTSLCTRDYKITQVLFPLLYTVLFFVGLITNGLAMRIFFQIRSKSNFIIFLKNTVISDLLMILTFPFKILSDAKLGTGPLRTFVCQVTSVIFYFTMYISISFLGLITIDRYQKTTRPFKTSNPKNLLGAKILSVVIWAFMFLLSLPNMILTNRQPRDKNVKKCSFLKSEFGLVWHEIVNYICQVIFWINFLIVIVCYTLITKELYRSYVRTRGVGKVPRKKVNVKVFIIIAVFFICFVPFHFARIPYTLSQTRDVFDCTAENTLFYVKESTLWLTSLNACLDPFIYFFLCKSFRNSLISMLKCPNSATSLSQDNRKKEQDGGDPNEETPM

SEQ ID NO: 796661 - protein, 342 aa, Homo sapiens; identical to SEQ ID NO: 796660

SEQ ID NO: 796662 - protein, 324 aa, Homo sapiens
MQAVDNLTSAPGNTSLCTRDYKITQVLFPLLYTVLFFVGLITNGLAMRIFFQIRSKSNFIIFLKNTVISDLLMILTFPFKILSDAKLGTGPLRTFVCQVTSVIFYFTMYISISFLGLITIDRYQKTTRPFKTSNPILSLPNMILTNRQPRDKNVKKCSFLKSEFGLVWHEIVNYICQVIFWINFLIVIVCYTLITKELYRSYVRTRGVGKVPRKKVNVKVFIIIAVFFICFVPFHFARIPYTLSQTRDVFDCTAENTLFYVKESTLWLTSLNACLDPFIYFFLCKSFRNSLISMLKCPNSATSLSQDNRKKEQDGGDPNEETPM

SEQ ID NO: 796663 - protein, 104 aa, Homo sapiens [sequence omitted]

SEQ ID NO: 796664 - protein, 155 aa, Homo sapiens
ASARRSPGTGTQSRGRLWGRQGSGLPRRRLTGGNRPRALGRGTQGLPTGLRGTQRPRHRIRPNPVPSRNGLLQLQSACRILSAKLEHKAAHQPSTDLNRQLRREPGMPALKCSPLEVFPCQRKKPSLVSRWSGVQDQPGQHGETPSLQKNTNISQ

SEQ ID NO: 796665 - protein, 46 aa, Homo sapiens
TSGSSLPFGIPSCFLVPEGFLFSKAGDRIIQALGLSGPGSGPADPL

SEQ ID NO: 796666 - protein, 102 aa, Homo sapiens
KLCSVLTQKTYNLIGNKQRNDHVDLPKLVSPGLQISVAYILTQVCLRPTHTSFRCQVLQLGSPRGLLAPAFHLHGLLTQVTALDWPAMGDTLLFFHQLGLIN

SEQ ID NO: 796667 - protein, 162 aa, Homo sapiens
GRRRPGPTSTSGVTREETGRKRNSGWLRGKPIQLGLRRLQGGGPKEVLAPPFKGPSLRVWEWDSRRLHRRKQDKTRELRRVTALIPSVPAAARTQAPLYPAVRRWSRGEGAPAGPLPRPAALPLLSQQPTASPALDPAGELPLIPGSAPRVAAPQARSPSGA

SEQ ID NO: 796668 - protein, 103 aa, Homo sapiens [sequence omitted]

SEQ ID NO: 796669 - protein, 371 aa, Homo sapiens
ERRNHHWRSYKLMIDPALKKGHHKLYRYDGQHFSLAMSSNRPVEIVEDPRVVGIWTKNKELELSVPKFKIDEFYVGPVPPKQVTFAKLNDNIRENFLRDMCKKYGEVEEVEILYNPKTKKHLGIAKVVFATVRGAKDAVQHLHSTSVMGNIIHVELDTKGETRMRFYELLVTGRYTPQTLPVGELDAVSPIVNETLQLSDALKRLKDGGLSAGCGSGSSSVTPNSGGTPFSQDTAYSSCRLDTPNSYGQGTPLTPRLGTPFSQDSSYSSRQPTPSYLFSQDPAVTFKARRHESKFTDAYNRRHEHHYVHNSPAVTAVAGATAAFRGSSDLPFGAVGGTGGSSGPPFKAQPQDSATFAHTPPPAQATPAPGF

SEQ ID NO: 796670 - protein, 305 aa, Homo sapiens
ERRNHHWRSYKLMIDPALKKGHHKLYRYDGQHFSLAMSSNRPVEIVEDPRVVGIWTKNKELELSVPKFKIDEFYVGPVPPKQVTFAKLNDNIRENFLRDMCKKYGEVEEVEILYNPKTKKHLGIAKVVFATVRGAKDAVQHLHSTSVMGNIIHVELDTKGETRMRFYELLVTGRYTPQTLPVGELDAVSPIVNETLQLSDALKRLKDGGLSAGCGSGSSSVTPNSGGTPFSQDTAYSSCRLDTPNSYGQGTPLTPRLGTPFSQDSSYSSRQPTPSYLFSQDPAVTFKARRHESKFTDADALMDEL

SEQ ID NO: 796671 - protein, 305 aa, Homo sapiens
ERRNHHWRSYKLMIDPALKKGHHKLYRYDGQHFSLAMSSNRPVEIVEDPRVVGIWTKNKELELSVPKFKIDEFYVGPVPPKQVTFAKLNDNIRENFLRDMCKKYGEVEEVEILYNPKTKKHLGIAKVVFATVRGAKDAVQHLHSTSVMGNIIHVELDTKGETRMRFYELLVTGRYTPQTLPVGELDAVSPIVNETLQDSSYSSRQPTPSYLFSQDPAVTFKARRHESKFTDAYNRRHEHHYVHNSPAVTAVAGATAAFRGSSDLPFGAVGGTGGSSGPPFKAQPQDSATFAHTPPPAQATPAPGF

SEQ ID NO: 796672 - protein, 69 aa, Homo sapiens
RPSTAAEHLVVVTVDAGCREARTPIPGFGLTLRLMQRAQRGAAGRDLLAGVPASSCLLHVNPESGGPSV

SEQ ID NO: 796673 - protein, 159 aa, Homo sapiens
SNTAPESDILDQEREDDFFMAFHTLPRRSSPHPFAQNGGEDGGGGLQGGVGALKRSSSMFIPQLLTSIDARPTCSSSVQISLQRKATDGATDGCGPPEGADDGPPCATPDPRDQASATATTRASPQSGSREPSPRDTPGSSPPRAARDPGLQVNGTCGR

SEQ ID NO: 796674 - protein, 164 aa, Homo sapiens
SAGKSVQCRKGQAESWLPAPNACLPPWGPGWHRSQACQWETWGKLGALVQQPALQQQAWPLEAVVLLASRIAFPFFLELQPLRKSEALAGTLPLCCAFTQRSIRADSQFQHCSWLGSALISGSPHRESAGPRGCGCLRAGLPCDSLLSWAWEWTPPIPAVHPVE

SEQ ID NO: 796675 - protein, 104 aa, Homo sapiens
YSFPALHPTSWAHCPHGQGILAETSAGPWGRRLLLTQQMGGWGDGEGYVFPTLPRSPVPLCHPCFHICPLGLETQALYSETLRPSGSPSKAALGEGCYRALLSC

SEQ ID NO: 796676 - protein, 79 aa, Homo sapiens
CGHESLEETNPQLTGAEGLVVRPNLARIGTISEPEEDSGGGELCPVVFTDWGAGARLFLGQNPVIGIVLTSTSAQLLWS

SEQ ID NO: 796677 - protein, 79 aa, Homo sapiens; identical to SEQ ID NO: 796676

SEQ ID NO: 796678 - protein, 184 aa, Homo sapiens [sequence omitted]

SEQ ID NO: 796679 - protein, 148 aa, Homo sapiens
LNFSLASWLPKGYTASAGLMSQNFDVAGLRHHFAIHYPGRGGLLDGLPGVAAVWGITKTEVLTIFQQVTVGGDLSLQLDLDVQQGLLLLGLALSLCRVCASSDSRCSRIQSTGSAPSAGCSGPPPPSGCSASWPSDFSCSPGQYPRTG

SEQ ID NO: 796680 - protein, 135 aa, Homo sapiens
RQDSLPVSPSHRLHLSKPPFHSLSHLQPGDISLLLCTLFLSRIFAQALTCTCSPPPPPALSPLIALPPSPFPRCAPSSSPPRPASPILPPLYRLCPISLPPFVPTSPPPPSPPLLSSLFPSALSPFSLLSPSRLR

SEQ ID NO: 796681 - protein, 42 aa, Homo sapiens
VPAARAPMETGSCPQVHLGCGGGWFHPGSVCASEKPTQGSTS

SEQ ID NO: 796682 - protein, 137 aa, Homo sapiens
CFPLLLLLSGWSGSGRADTHCLCYDFIITPKFRPEPRWCEVQGLVDERPFLHYDCVNHKAKAFASLRKKVNVTKTWEEQTETLRDFSLLSHTSTLRQTETLRDVGDFLKGQLPDIEMENVIPIGKFKIVQDSREQTQ

SEQ ID NO: 796683 - protein, 113 aa, Homo sapiens [sequence omitted]

SEQ ID NO: 796684 - protein, 147 aa, Homo sapiens
LRPPEQLPRRSRSRMVRGARQPQQPRSRLAPRLTGTVEKPPRKRRSRTEFTLKEIMSSGGAEDDIPQGERKTVTDFCYLLDKSKQLFNGLRLECDGAILLTATSASWVQVILLPPSDSPASKRFSCLGTHRPPTPSSWDYRCLSPCP

SEQ ID NO: 796685 - protein, 303 aa, Homo sapiens
LRPPEQLPRRSRSRMVRGARQPQQPRSRLAPRLTGTVEKPPRKRRSRTEFTLKEIMSSGGAEDDIPQGERKTVTDFCYLLDKSKQLFNGLRDLPQYGQKQWQSYFGRTFDVYTKLWKFQQQHRQVLDNRYGLKRWQIGEIASKIGQLYYHYYLRTSETSYLNEAFSFYSAIRQRSYYSQVNKEDRPELVVKKLRYYARFIVVCLLLNKMDVVKDLVKELSDEIEDYTHRFNTEDQVEWNLVLQEVAAFIEADPVMVLNDDNTIVITSNRLAETGAPLLEQGMIVGQLSLADALIIGNCNNQVK

SEQ ID NO: 796686 - protein, 384 aa, Homo sapiens
MARALVQLWAICMLRVALATVYFQEEFLDGEHWRNRWLQSTNDSRFGHFRLSSGKFYGHKEKDKGLQTTQNGRFYAISARFKPFSNKGKTLVIQYTVKHEQKMDCGGGYIKVFPADIDQKNLNGKSQYYIMFGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 796687 - protein, 316 aa, Homo sapiens
MARALVQLWAICMLRVALATVYFQEEFLDGEHWRNRWLQSTNDSRFGHFRLSSGKFYGHKEKDKGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 796688 - protein, 72 aa, Homo sapiens
PRLARQSPTSPTVPDQPDSLHQPGSCLTLAPLGPAHASRWPLRAQLPPSLTAPPGPKLPSSMWPKVAQSVPK

SEQ ID NO: 796689 - protein, 135 aa, Homo sapiens
TRRQNPADLRCTVLHVFPGHSRLIILLQREMLYISSSAGPWGSPRPFLSAYRLSCLIIHSRNFARAQLCELWCLATLSDQPFSFVGAPGQSSLCPSPVSVPSHCACGPRMQSLCTYGRSCQHPKQNEAALGTRVN

SEQ ID NO: 796690 - protein, 239 aa, Homo sapiens
MQDPNADTEWNDILRKKGILPPKESLKELEEEAEEEQRILQQSVVKTYEDMTLEELEDHEDEFNEEDERAIEMYRRRRLAEWKATKLKNKFGEVLEISGKDYVQEVTKAGEGLWVILHLYKQGIPLCALINQHLSGLARKFPDVKFIKAISTTCIPNYPDRNLPTIFVYLEGDIKAQFIGPLVFGGMNLTRDELEWKLSESGAIMTDLEENPKKPIEDVLLSSVRRSVLMKRDSDSEGD

SEQ ID NO: 796691 - protein, 239 aa, Homo sapiens; identical to SEQ ID NO: 796690

SEQ ID NO: 796692 - protein, 221 aa, Homo sapiens
MQDPNADTEWNDILRKKGILPPKESLKELEEEAEEEQRILQQSVVKTYEDMTLEELEDHEDEFNEEDERAIEMYRRRRLAEWKATKLKNKFGEVLEISGKDYVQEVTKAGEGLWVILHLYKQGIPLCALINQHLSGLARKFPDVKFIKAISTTCIPNYPDRNLPTIFVYLEGDIKAQFIGPLVFGGMNLTRDELEWKLSESGAIMTDLEDLMKRDSDSEGD

SEQ ID NO: 796693 - protein, 97 aa, Homo sapiens
GACNHLHLFPGKDSAPGDSLLAMGMRTNSPFILEIGLPPHILEEPTEKPAGLPHLDGASGWPGPPRGPLLHLTGSPWGIRLPCHFHCGHWKCGRENS

SEQ ID NO: 796694 - protein, 115 aa, Homo sapiens
WNQCCRAGDQCLWPVKPSPKTFWEALRVSEEPGRKDSLLAMGMRTNSPFILEIGLPPHILEEPTEKPAGLPHLDGASGWPGPPRGPLLHLTGSPWGIRLPCHFHCGHWKCGRENS

SEQ ID NO: 796695 - protein, 319 aa, Homo sapiens
TALLYKPIDRVTRSTLVLHDLLKHTPVDHPDYPLLQDALRISQNFLSSINEDIDPRRTAVTTPKGETRQLVKDGFLVEVSESSRKLRHVFLFTDVLLCAKLKKTSAGKHQQYDCKWYIPLADLVFPSPEESEASPQVHPFPDHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCSLEVDSFGYLVSKAKTRVFRDTAEPNW

SEQ ID NO: 796696 - protein, 186 aa, Homo sapiens
SRGSMHHSRHELEDMKMKISALKSEIQKEKANKGQSRAIERLKKKMFENEFLLLLNSPTIPFRIHNRNGKSYLFLLSSDYERSEWREAIQKLQKKDLQAFVLSSVELQVLTGSCFKLRTVHNIPVTSNKDDDESPGLYGFLHVIVHSAKGFKQSANLYCSLEVDSFGYLVSKAKTRVFRDTAEPNW

SEQ ID NO: 796697 - protein, 56 aa, Homo sapiens
MSDRMDLRRRYNTHPMMHGWPPQTLMQATPWRSLSWPGSVLFTLLEEHWPGTVAHT

SEQ ID NO: 796698 - protein, 140 aa, Homo sapiens
MGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKQDEL

SEQ ID NO: 796699 - protein, 108 aa, Homo sapiens
GEMDMFAVLGVVIALWFLHCVCVCVCVCVNDRLLCVPIKSRNLLSYPLRKKFDDNWIRSIIIHLCVFRALGSAIIGGQGAATQDGPCLNRAVLIYLWHRFGFWLSSKI

SEQ ID NO: 796700 - protein, 108 aa, Homo sapiens
PQPSPGLWAAVCLLCCFFLVLSHSGYPFIQLCPLNLWIVMLEGCSFLLHKGIALTRIITQQSHSYPFSFSFSSKSLGRETAPSSTDGEDQIGLGTLRDAVNSMLQGLS

SEQ ID NO: 796701 - protein, 68 aa, Homo sapiens
FPFWRPLVLVTAACWEMESEGRDLCYLWECGLEGTEERGAEGARNQAGAVAHAGIIGVSHHARPDLAN

SEQ ID NO: 796702 - protein, 264 aa, Homo sapiens
LSCGRGSLFRRMGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMDKIYEGQVEVTGDEYNVESIDGQPGAFTCYLDAGLARTTTGNKVFGALKGAVDGGLSIPHSTKRFPGYDSESKEFNAEVHRKHIMGQNVADYMRYLMEEDEDAYKKQFSQYIKNSVTPDMMEEMYKESSCCYTRESSL

SEQ ID NO: 796703 - protein, 358 aa, Homo sapiens
MATADTPAPASSGLSPKEEGELEDGEISDDDNNSQIRSRSSSSSSGGGLLPYPRRRPPHSARGGGSGGGGGSSSSSSSSQQQLRNFSRSRHASERGHLRGPSSYRPKEPFRSHPPSVRMPSSSLSESSPRPSFWERSHLALDRFRFRGRPYRGGSRWSRGRGVGERGGKPGCRPPLGGGAGSGFSSSQSWREPSPPRKSSKSFGRSPSRKQNYSSKNENCVEETFEDLLLKYKQIQLELECINKDEKLALSSKEENVQEDPKTLNFEDQTSTDNVSITKDSSKEVAPEEKTQVKTFQAFELKPLRQKLTLPGDKNRLKKVKDGAKPLSLKSDTTDSSQGIPYRVKEGFTPIPGLKFSA

SEQ ID NO: 796704 - protein, 212 aa, Homo sapiens
MATADTPAPASSGLSPKEEGELEDGEISDDDNNSQIRSRSSSSSSGGGLLPYPRRRPPHSARGGGSGGGGGSSSSSSSSQQQLRNFSRSRHASERGHLRGPSSYRPKEPFRSHPPSVRMPSSSLSESSPRPSFWERSHLALDRFRFRGRPYRGGSRWSRGRGVGERGGKPGCRPPLGGGAGSGFSSSQSWREPSPPRKSCILNVAVGAGCCT

SEQ ID NO: 796705 - protein, 102 aa, Homo sapiens
PSPTPAGQQVLDVDSCLDSSVLDSSFLTSEASTLSEGSTGGPAALAQLGLKTLCTSQQAFAGQMKSDLFLDDSKRLSILWLTIVIVGLTLVEVLGYLSLLCF

SEQ ID NO: 796706 - protein, 91 aa, Homo sapiens
GMPSSISLRRDSQPLDFPRAASCRLVPNDDSLTWTQPVGNILTFVARLQGHRWFGDSQTMIQQTCEAVSSLSEHNLQVVLCHIPGTKLQAQ

SEQ ID NO: 796707 - protein, 84 aa, Homo sapiens
GMPSSISLRRDSQPLDFPRAASCRLVPNDDSLTWTQPVGNILTFVARLQGHRWFGDSQTMIQQTCEAVSSLSEHNLQEALEHIT

SEQ ID NO: 796708 - protein, 145 aa, Homo sapiens
MGKEKTHINIVVIGHVDSGKSTTTGHLIYKCGGIDKRTIEKFEKEAAEMGKAPSSMPGSGKLKAERERGTIDISCGGDQQYYVTIIDAPGHRDFDNVITGTSQVDCAVLIVAAGVGEFEAGISKNGQTSEHALLAYTLDVKQLIV

SEQ ID NO: 796709 - protein, 49 aa, Homo sapiens
MLTVSGHRGGARANRAHAHTVSGHRGGARANTRLSVYSVNKRSLRSYSG

SEQ ID NO: 796710 - protein, 47 aa, Homo sapiens
MVKPLAVPEAFSGPRASYTFCSESMPSTVPCPLAMPFVHQVEPPLKA

SEQ ID NO: 796711 - protein, 69 aa, Homo sapiens
HILDFLGTRERTLGITPDDDDSSPPLVVKDEECSPDCSWQPLCDQRGMSLWMKPTQWREGWRHGRNWAL

SEQ ID NO: 796712 - protein, 68 aa, Homo sapiens
ENTKGTGIEVNAWILQKVPRNPRPSLYSVGATGHVAAQHWKCAWPELRCPPESVRTCQILKIQFEKRM

SEQ ID NO: 796713 - protein, 88 aa, Homo sapiens
RQGSGVKWTVKVNHILSYSLLPAGALQAPPLVTTVEINCMCLNLRVQLLLDGGTFQSLVRPVSTQQVQMPSRCCDLPAISPFLSQPRK

SEQ ID NO: 796714 - protein, 396 aa, Homo sapiens
RNGRHLSLHSAAVAPALKLSRGAAAEAAVAPAPPCWWRSLCLLPTWRKGAGAHATGSVGLRPSSSYSDPRIPRPRSLYASSLAAGRPLHTAAVPCVWTACGRLARPHSPRLAAPLPSMSALEWYAHKSLGDGIFWIQERFYESGNRANIWLVRGSEQDVVIDTGLGLRSLPEYLYSSGLLQDREAKEDAARRPLLAVATHVHFDHSGGLYQFDRVAVHHAEAEALARGDNFETVTWLSDSEVVRAPSPGWRARQFRVQAVQPTLILQDGDVINLGDRQLTVMHMPGHSRGSICLHDKDRKILFSGDVVYDGSLIDWLPYSRISDYVGTCERLIELVDRGLVEKVLPGHFNTFGAERLFRLASNYISKAGICHKVSTFAMRSLASLALRVTNSRTSP

SEQ ID NO: 796715 - protein, 260 aa, Homo sapiens
MNSAAGFSHLDRRERVLKLGESFEKQPRCAFHTVRYDFKPASIDTSSEGYLEVGEGEQVTITLPNIEGSTPPVTVFKGSKKPYLKECILIINHDTGECRLEKLSSNITVKKTRVEGSSKIQYRKEQQQQQMWNSARTPNLVKHSPSEDKMSPASPIDDIERELKAEASLMDQMSSCDSSSDSKSSSSSSSEDSSSDSEDEDCKSSTSDTGNCVSGHPTMTQYRIPDIDASHNRFRDNSGLLMNTLRNDLQLSESGSDSDD

SEQ ID NO: 796716 - protein, 130 aa, Homo sapiens
MWNSARTPNLVKHSPSEDKMSPASPIDDIERELKAEASLMDQMSSCDSSSDSKSSSSSSSEDSSSDSEDEDCKSSTSDTGNCVSGHPTMTQYRIPDIDASHNRFRDNSGLLMNTLRNDLQLSESGSDSDD

SEQ ID NO: 796717 - protein, 271 aa, Homo sapiens
MRWCCAGSAVSLSSVPFSGSVICVFIWFFHAFFSNSIYSLLFSSFSDDFKPASIDTSSEGYLEVGEGEQVTITLPNIEGSTPPVTVFKGSKKPYLKECILIINHDTGECRLEKLSSNITVKKTRVEGSSKIQYRKEQQQQQMWNSARTPNLVKHSPSEDKMSPASPIDDIERELKAEASLMDQMSSCDSSSDSKSSSSSSSEDSSSDSEDEDCKSSTSDTGNCVSGHPTMTQYRIPDIDASHNRFRDNSGLLMNTLRNDLQLSESGSDSDD

SEQ ID NO: 796718 - protein, 130 aa, Homo sapiens; identical to SEQ ID NO: 796716

SEQ ID NO: 796719 - protein, 271 aa, Homo sapiens; identical to SEQ ID NO: 796717

SEQ ID NO: 796720 - protein, 276 aa, Homo sapiens
VRHFFPGFGDSDLKVIMNSAAGFSHLDRRERVLKLGESFEKQPRCAFHTVRYDFKPASIDTSSEGYLEVGEGEQVTITLPNIEGSTPPVTVFKGSKKPYLKECILIINHDTGECRLEKLSSNITVKKTRVEGSSKIQYRKEQQQQQMWNSARTPNLVKHSPSEDKMSPASPIDDIERELKAEASLMDQMSSCDSSSDSKSSSSSSSEDSSSDSEDEDCKSSTSDTGNCVSGHPTMTQYRIPDIDASHNRFRDNSGLLMNTLRNDLQLSESGSDSDD

SEQ ID NO: 796721 - protein, 249 aa, Homo sapiens
GVYMSRSLGESFEKQPRCAFHTVRYDFKPASIDTSSEGYLEVGEGEQVTITLPNIEGSTPPVTVFKGSKKPYLKECILIINHDTGECRLEKLSSNITVKKTRVEGSSKIQYRKEQQQQQMWNSARTPNLVKHSPSEDKMSPASPIDDIERELKAEASLMDQMSSCDSSSDSKSSSSSSSEDSSSDSEDEDCKSSTSDTGNCVSGHPTMTQYRIPDIDASHNRFRDNSGLLMNTLRNDLQLSESGSDSDD

SEQ ID NO: 796722 - protein, 130 aa, Homo sapiens; identical to SEQ ID NO: 796716

SEQ ID NO: 796723 - protein, 260 aa, Homo sapiens; identical to SEQ ID NO: 796715

SEQ ID NO: 796724 - protein, 260 aa, Homo sapiens; identical to SEQ ID NO: 796715

SEQ ID NO: 796725 - protein, 245 aa, Homo sapiens
MNSAAGFSHLDRRERVLKLGESFEKQPRCAFHTVRYDFKPASIDTSSEGYLEVGEGEQVTITLPNIEGSTPPVTVFKGSKKPYLKECILIINHDTGECRLEKLSSNITVKKTRVEGSSKIQYRKEQQQQQMWNSARTPNLVKHSPSEDKMSPASPIDDIERELKAEASLMDQMSSCDSSSDSKDEDCKSSTSDTGNCVSGHPTMTQYRIPDIDASHNRFRDNSGLLMNTLRNDLQLSESGSDSDD

SEQ ID NO: 796726 - protein, 69 aa, Homo sapiens
TCVGTHWLHGARFLFPEPCSPALCLSLPSRSAHFLSALGPCGLCFASCPAVMTSFHSSAISVFIVLFDL

SEQ ID NO: 796727 - protein, 123 aa, Homo sapiens
HVLAGHCALNRFFQRTAVTAVFKCALASKDQGGGGGRGCPLYKKCCPASFPTDTLGHLSDSRGGQLCLPQATTAATDGHSHQQSTKKHQSLCELGCDDKNQMFSNLRLVCRTQEIAIRNTLQN

SEQ ID NO: 796728 - protein, 324 aa, Homo sapiens [sequence omitted]

SEQ ID NO: 796729 - protein, 519 aa, Homo sapiens
MTSLAQQLQRLALPQSDASLLSRDEVASLLFDPKEAATIDRDTAFAIGCTGLEELLGIDPSFEQFEAPLFSQLAKTLERSVQTKAVNKQLDENISLFLIHLSPYFLLKPAQKCLEWLIHRFHIHLYNQDSLIACVLPYHETRIFVRVIQLLKINNSKHRWFWLLPVKQSGVPLAKGTLITHCYKDLGFMDFICSLVTKSVKVFAEYPGSSAQLRVLLAFYASTIVSALVAAEDVSDNIIAKLFPYIQKGLKSSLPDYRAATYMIICQISVKVTMENTFVNSLASQIIKTLTKIPSLIKDGLSCLIVLLQRQKPESLGKKPFPHLCNVPDLITILHGISETYDVSPLLHYMLPHLVVSIIHHVTGEETEGMDGQIYKRHLEAILTKISLKNNLDHLLASLLFEEYISYSSQEEMDSNKVSLLNEQFLPLIRLLESKYPRTLDVVLEEHLKEIADLKKQELFHQFVSLSTSGGKYQFLADSDTSLMLSLNHPLAPVRILAMNHLKKIMKTSKVCFRSLFYM

SEQ ID NO: 796730 - protein, 80 aa, Homo sapiens [sequence omitted]

SEQ ID NO: 796731 - protein, 182 aa, Homo sapiens
MYEIKNSFGQRIYFAAEDTNFCIRNCCGRSRPFTLRITDNVGREVITLERPLRCNCCCCPCCLQEIEIQAPPGVPVGYVTQTWHPCLTKFTIKNQKREDVLKISGPCIVCSCIAGVDFEITSLDEQIVVGRISKHWSGFLREAFTDADNFGIQFPRDLDVKMKAVMIGACFLIDYMFFERTR

SEQ ID NO: 796732 - protein, 183 aa, Homo sapiens
AAAWPSGPSAPEAVTARLVGVLWFVSVTTGPWGAVATSAGGEESLKCEDLKVGQYPLWRTPPHGGEVELGSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 796733 - protein, 85 aa, Homo sapiens
PASISSRWKGSGRGYIEPLLMLAGALGDLIPSTRQHQQQVLQAVERAKQVTVGELNSLIGVSLSSPCPAMGRRPLPGPWHPPRRC

SEQ ID NO: 796734 - protein, 835 aa, Homo sapiens
AAALAALPPRPLPLPAPLAPRTPTRGGAPTTPGARAWGRARDSRVPCPAPLLPPPSFFGQPPHHPTSASPTLAASISSSSGGAWGAFRIGRMYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 796735 - protein, 744 aa, Homo sapiens
MYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 796736 - protein, 823 aa, Homo sapiens
AAALAALPPRPLPLPAPLAPRTPTRGGAPTTPGARAWGRARDSRVPCPAPLLPPPSFFGQPPHHPTSASPTLAASISSSSGGAWGAFRIGRMYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 796737 - protein, 804 aa, Homo sapiens
AAALAALPPRPLPLPAPLAPRTPTRGGAPTTPGARAWGRARDSRVPCPAPLLPPPSFFGQPPHHPTSASPTLAASISSSSGGAWGAFRIGRMYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQMAFESHPHLRGSSVSSSLPSIPGGKPAYSFHVSADGQMQPVPFPSDALVGAGIPRHARQLHTLAHGEVVCAVTISGSTQHVYTGGKGCVKNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 796738 - protein, 653 aa, Homo sapiens
VGGPWSLHQQQVLQAVERAKQVTVGELNSLIGQQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 796739 - protein, 828 aa, Homo sapiens
AAALAALPPRPLPLPAPLAPRTPTRGGAPTTPGARAWGRARDSRVPCPAPLLPPPSFFGQPPHHPTSASPTLAASISSSSGGAWGAFRIGRMYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSLRQASTFHGQRRPEEPPDSVQSLHHVLQPGLPQHSQRRPLRAQLLRQPPPVPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 796740 - protein, 630 aa, Homo sapiens
MYPQGRHPTPLQSGQPFKFSILEICDRIKEEFQFLQAQYHSLKLECEKLASEKTEMQRHYVMYYEMSYGLNIEMHKQSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 796741 - protein, 578 aa, Homo sapiens
AAALAALPPRPLPLPAPLAPRTPTRGGAPTTPGARAWGRARDSRVPCPAPLLPPPSFFGQPPHHPTSASPTLAASISSSSGGAWGAFRIGRMYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 796742 - protein, 542 aa, Homo sapiens
MTPLPVPEVQTPRGISSRDRHPSSRLPALPRNRTSHLLSWPTASHLPLPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 796743 - protein, 784 aa, Homo sapiens
AAALAALPPRPLPLPAPLAPRTPTRGGAPTTPGARAWGRARDSRVPCPAPLLPPPSFFGQPPHHPTSASPTLAASISSSSGGAWGAFRIGRMYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCVQGVVLSPEL

SEQ ID NO: 796744 - protein, 290 aa, Homo sapiens
LKLKGFPEDFQETGSTKHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDNTVRCWDLREGRQLQQHDFSSQIFSLGHCPNQDWLAVGMESSNVEILHVRKPEKYQLHLHESCVLSLKFASCGRWFVSTGKDNLLNAWRTPYGASIFQSKESSSVLSCDISRNNKYIVTGSGDKKATVYEVVY

SEQ ID NO: 796745 - protein, 754 aa, Homo sapiens
AAALAALPPRPLPLPAPLAPRTPTRGGAPTTPGARAWGRARDSRVPCPAPLLPPPSFFGQPPHHPTSASPTLAASISSSSGGAWGAFRIGRMYPQGRHPTPLQSGQPFKFSILEICDRIKEEFQFLQAQYHSLKLECEKLASEKTEMQRHYVMYYEMSYGLNIEMHKQAEIVKRLSGICAQIIPFLTQEHQQQVLQAVERAKQVTVGELNSLIGQQQLQPLSHHAPPVPLTPRPAGLVGGSATGLLALSGALAAQAQLAAAVKEDRAGVEAEGSRVERAPSRSASPSPPESLVEEERPSGPGGGGKQRADEKEPSGPYESDEDKSDYNLVVDEDQPSEPPSPATTPCGKVPICIPARRDLVDSPASLASSLGSPLPRAKELILNDLPASTPASKSCDSSPPQDASTPGPSSASHLCQLAAKPAPSTDSVALRSPLTLSSPFTTSFSLGSHSTLNGDLSVPSSYVSLHLSPQVSSSVVYGRSPVMAFESHPHLRGSSVSSSLPSIPGGKPAYSFHVSADGQMQPVPFPSDALVGAGIPRHARQLHTLAHGEVVCAVTISGSTQHVYTGGKGCVKVWDVGQPGAKTPVAQLDCLNRDNYIRSCKLLPDGRSLIVGGEASTLSIWDLAAPTPRIKAELTSSAPACYALAVSPDAKVCFSCCSDGNIVVWDLQNQTMVRQFQGHTDGASCIDISDYGTRLWTGGLDTLAHGEVVCAVTISGSTQHVYTGGKGCVKVWDVGQPGAKTPVAQLDCLNRDN

SEQ ID NO: 796746 - protein, 136 aa, Homo sapiens
GRPRRAPAPAAAPARPARPAHPNPGRGSHDPGRARLGARQGLQGPLPRAASPSSLFLRAASPPPHFSLPHSCRLHIIKLWWRLGGFSDRQDVPPGKAPDPAPVRPALQVLDLGDLRPHQRRIPVSSGSIPQPQARM

SEQ ID NO: 796747 - protein, 77 aa, Homo sapiens
SDPPGQEIRGRVDTACEEDDKKGRDEAPCPEELTSQQFTGYGYRGESGGESIVGVAPLTSRMASRDPASWWPLSPSY

SEQ ID NO: 796748 - protein, 75 aa, Homo sapiens
MICRQDVHFFPLLGFFAQLLLDTPAGLFSRGHHRGSCRGLVLQDPLDWPVRGSPGRHFWALWLLAQGRCLAWSPE

SEQ ID NO: 796749 - protein, 126 aa, Homo sapiens
MPRHPGSPILGYTVFYSEVGADKSLQEQLHSVPLSRDIPTTEEVIGDLKPGTEYRVSIAAYSQAGKGRLSSPRHVTTLSQDSCLPPAAPQQPHVIVVSDSEVALSWKPGASEGSAPIQYYSVEFIR

SEQ ID NO: 796750 - protein, 201 aa, Homo sapiens
MDLIRGVLLRLLLLASSLGPGAVSLRAAIRKPGKVGPPLDIKLGALNCTAFSIQWKMPRHPGSPILGYTVFYSEVGADKSLQEQLHSVPLSRDIPTTEEVIGDLKPGTEYRVSIAAYSQAGKGRLSSPRHVTTLSQDSCLPPAAPQQPHVIVVSDSEVALSWKPGASEGSAPIQYYSVEFIRPDFDKKWTSIHERIQMDSM

SEQ ID NO: 796751 - protein, 386 aa, Homo sapiens
LARPALPCKMAAPRWSASGPWIRGNGQGCGSLFTLVSKPFCAAAAASTAINAQRLAEKLRAQKREQDTKKEPVSTNAVQRRVQEIVRFTRQLQRVHPNVLAKALTRGILHQDKNLVVINKPYGLPVHGGPGVQLCITDVLPILAKMLHGHKAEPLHLCHRLDKETTGVMVLAWDKDMAHQVQELFRTRQVVKKYWAITVHVPMPSAGVVDIPIVEKEAQGQQQHHKMTLSPSYRMDDGKMVKVRRSRNAQVAVTQYQVLSSTLSSALVELQPITGIKHQLRVHLSFGLDCPILGDHKYSDWNRLAPQKLSVGTLKKLGLEQSKARYIPLHLHARQLILPALGSGKEELNLVCKLPRFFVHSLHRLRLEMPNEDQNENNEAKCLGAQ

SEQ ID NO: 796752 - protein, 214 aa, Homo sapiens
LARPALPCKMAAPRWSASGPWIRGNGQGCGSLFTLVSKPFCAAAAASTAINAQRLAEKLRAQKREQDTKKEPVSTNAVQRRVQEIVRFTRQLQRVHPNVLAKALTRGILHQDKNLVVINKPYGLPVHGGPGVQLCITDVLPILAKMLHGHKAEPLHLCHRLDKETTGVMVLAWDKDMAHQVQELFRTRQVVKKYWNKTSASSSLVFWIGLSNPW

SEQ ID NO: 796753 - protein, 184 aa, Homo sapiens
MPSAGVVDIPIVEKEAQGQQQHHKMTLSPSYRMDDGKMVKVRRSRNAQVAVTQYQVLSSTLSSALVELQPITGIKHQLRVHLSFGLDCPILGDHKYSDWNRLAPQKLSVGTLKKLGLEQSKARYIPLHLHARQLILPALGSGKEELNLVCKLPRFFVHSLHRLRLEMPNEDQNENNEAKCLGAQ

SEQ ID NO: 796754 - protein, 143 aa, Homo sapiens
MPSAGVVDIPIVEKEAQGQQQHHKMTLSPSYRMDDGKMVKVRRSRNAQVAVTQYQVLSSTLSSALVELQPITGIKHQLRVHLSFGLDCPILGDHKYSDWNRLAPQKLSVGTLKKLGLEQSKARYIPLHLHARQITCTHEAGWV

SEQ ID NO: 796755 - protein, 199 aa, Homo sapiens
LARPALPCKMAAPRWSASGPWIRGNGQGCGSLFTLVSKPFCAAAAASTAINAQRLAEKLRAQKREQDTKKEPVSTNAVQRRVQEIVRFTRQLQRVHPNVLAKALTRGILHQDKNLVVINKPYGLPVHGGPGVQLCITDVLPILAKMLHGHKAEPLHLCHRLDKETTGVMVLAWDKDMAHQVQELFRTRQVVKKYWYEAC

SEQ ID NO: 796756 - protein, 184 aa, Homo sapiens; identical to SEQ ID NO: 796753

SEQ ID NO: 796757 - protein, 193 aa, Homo sapiens
MVAITVHVPMPSAGVVDIPIVEKEAQGQQQHHKMTLSPSYRMDDGKMVKVRRSRNAQVAVTQYQVLSSTLSSALVELQPITGIKHQLRVHLSFGLDCPILGDHKYSDWNRLAPQKLSVGTLKKLGLEQSKARYIPLHLHARQLILPALGSGKEELNLVCKLPRFFVHSLHRLRLEMPNEDQNENNEAKCLGAQ

SEQ ID NO: 796758 - protein, 386 aa, Homo sapiens; identical to SEQ ID NO: 796751

SEQ ID NO: 796759 - protein, 386 aa, Homo sapiens; identical to SEQ ID NO: 796751

SEQ ID NO: 796760 - protein, 67 aa, Homo sapiens
LVQSRTTMTAISSSSHCTSSIDGKHVDVVSDQAALQLSPKGKLSESPKEESLEEPSMRQSSPAETVD

SEQ ID NO: 796761 - protein, 82 aa, Homo sapiens
DSEGDRVLGEWMGGEHPVVSAAGAAEGLGLLLGYRKHHFWGIVSWTLVTLTADPWNLHQRGFPWGKISVSGRLMVLLPQHHQ

SEQ ID NO: 796762 - protein, 368 aa, Homo sapiens
NFDCEDSGHLTDSECNQKHTSKKGSLIERKRSSGRVRRKGDEPQASGYHSEGETLKEKQAPRNASKPSSSTNRLRDFKETVSNMIHNRPSLASQTNVGSHCRGRGGDQPDKKPPRTLPLHSRDWEIESTSSESKSSSSSKYRPTWRPKRESLNIDSIFSKDKRKHCGYTQLSPFSEDSAKEFIPDEPSKPPSYDIKFGGPSPQYKRWGPARPGSHLLEQHPRLIQRMESGYESSERNSSSPVSLDAALPESSNVYRDPSAKRSAGLVPSWRHIPKSHSSSILEVDSTASMGGWTKSQPFSGEEISSKSELDELQEEVARRAQEQELRRKREKELEAAKGFNPHPSRFMDLDELQNQGRSDGFERSLQE

SEQ ID NO: 796763 - protein, 121 aa, Homo sapiens
AGPVSPYVPSVLHVEHLRFPATHQGLQEIQTQPSPPQSRKPQLSAGGGSMQLLQPCPLLLPQGCLGVGHSVPERAVIWRPGMLTSVQGLSEGPSAPRRCCGYRKQTEGLLLLSVGGRGMDV

SEQ ID NO: 796764 - protein, 108 aa, Homo sapiens
MLATIILCHKMRSKCWQNVAVFPDDGEHSQHTLKEIRGGSCALLRVTASSASKQQWTKATQGSGKPSYSDLPWGRVFKGDTQQPPPYLARQRQRTRNCEHEHGLVPDG

SEQ ID NO: 796765 - protein, 112 aa, Homo sapiens
HLVVTTFPPDIFSSQKNEHSPHLKQPERLGLQGRYRPYGRQLVGKSPGFYALRGHLWGTLRPSPAGLLAFGLELHHQLSEVSTRQLTLQITELVSLHNCRSQCLIIKSLSLV

SEQ ID NO: 796766 - protein, 86 aa, Homo sapiens
LTAAVSSQGDPHRNTQSLLLRTKDRVSVIYSHLPVTKKTRTFPLKIANVSFKQGAPCARGCGRSEESGFVPAAVSKAWVTPSIAEA

SEQ ID NO: 796767 - protein, 124 aa, Homo sapiens
YGSPGDIDLWPALMVEDLIPGTRVGPTLMCLFVTQFQRLRDGDRFWYENPGVFTPAQLTQLKQASLSRVLCDNGDSIQQVQADVFVKAEYPQDYLNCSEIPKVDLRVWQDCCAETVGVEDSSEQ

SEQ ID NO: 796768 - protein, 131 aa, Homo sapiens
ARTQVTGQPLPSCVPLISRSCLQHRTEHLLSIRPWGGSLATERKEDSCPGGAPTLWADAGGREMTVAGEWEKSLDSQAPRAITDRLLMTANIRKPNVLGVGISVFPGKAPSMQYLSRAKRQLPRHSVCTWY

SEQ ID NO: 796769 - protein, 520 aa, Homo sapiens
METWSVEQVCSWLVEKNLGELVHRFQEEEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRRNVKQILARSKALQWTKSYVLPEFPYDVKCMLAEQKCPDHSMRIRIIEFLQADMTKYLEGSLYPSTQQYNDVVNALLQAHPFLDEDGCGFFLWKRALKDRFKYVRRPIEDDEQVIRNKCKFGHRRGQTRKSLADIRFDEIKLVQIKEEAVCFDSELDEHIKWFQQEYVKTEKDWREIDKRMSQTLEIRRKMIGSRTPLKDILKLFPFLKCPYQMFREFQLLTRTDIYKKTRHILESYSENILTSFSVVDNPINIVLQEKMKHYTDEDMLKYMKMTATCLLLPDVFGDDPSLFVIMNEQVQVSTPVLEVKNPFNMEVCEFSLYLERERLTKVDDCVTALAALVAAFHVFRIECPRRLSQTFNFLETLIFDMHSPYFPSLKEKENEVGFQHPLT

SEQ ID NO: 796770 - protein, 520 aa, Homo sapiens; identical to SEQ ID NO: 796769

SEQ ID NO: 796771 - protein, 279 aa, Homo sapiens
METWSVEQVCSWLVEKNLGELVHRFQEEEVSGAALLALNDRMVQQLVKKIGHQAVLMDLIKKYKQNTQGLKSPENPKKAALVMQTEAARDYRDEESSSPARHGEQMPSFYPAENLDNGLIDQRVLKQRRNVKQILARSKALQWTKSYVLPEFPYDVKCMLAEQKCPDHSMRIRIIEFLQADMTKYLEGSLYPSTQQYNDVVNALLQAHPFLDEDGCGFFLWKRALKDRFKYVRRPIEDDEQVIRNKCKFGHRRGQTRKSLADIRFDEIKLVQIKVRLNS

SEQ ID NO: 796772 - protein, 324 aa, Homo sapiens
AGQPGSGQVVRPQQCCPKCVEPHTPSGLRAPPKSCQHNGTMYQHGEIFSAHELFPSRLPNQCVLCSCTEGQIYCGLTTCPEPGCPAPLPLPDSCCQACKAGSSWGLLCSVSDFHPSCHLQRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKGHWNVFLAQTLELKVTASPDKVTKT

SEQ ID NO: 796773 - protein, 90 aa, Homo sapiens
GDRSRISKENRQKKTGFTVEATGRQGRGMTGNLPLDSDQESQEARLPERGTALPTARWPPRRSLERLPSPDPGAEGHGQSRQSDQDITKT

SEQ ID NO: 796774 - protein, 377 aa, Homo sapiens
AGQPGSGQVVRPQQCCPKCVEPHTPSGLRAPPKSCQHNGTMYQHGEIFSAHELFPSRLPNQCVLCSCTEGQIYCGLTTCPEPGCPAPLPLPDSCCQACKAGSSWGLLCSVSDFHPSCHLQRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKDEETEAQRGEVPGPRPHSQNLPLDSDQESQEARLPERGTALPTARWPPRRSLERLPSPDPGAEGHGQSRQSDQDITKT

SEQ ID NO: 796775 - protein, 355 aa, Homo sapiens
AGQPGSGQVVRPQQCCPKCVEPHTPSGLRAPPKSCQHNGTMYQHGEIFSAHELFPSRLPNQCVLCSCTEGQIYCGLTTCPEPGCPAPLPLPDSCCQACKAGSSWGLLCSVSDFHPSCHLQRHPQDPCSSDAGRKRGPGTPAPTGLSAPLSFIPRHFRPKGAGSTTVKIVLKEKHKKACVHGGKTYSHGEVWHPAFRAFGPLPCILCTCEDGRQDCQRVTCPTEYPCRHPEKVAGKCCKICPEDKADPGHSEISSTRCPKAPGRVLVHTSVSPSPDNLRRFALEHEASDLVEIYLWKLVKGIFHLTQIKKVRKQDFQKEAQHFRLLAGPHEGHWNVFLAQTLELKVTASPDKVTKT

SEQ ID NO: 796776 - protein, 103 aa, Homo sapiens
IPLLSNSPMQCLLISTEKQEAPGTPFRDCHQSTRKSFMKGETLTHSFFILWHGDEHTWYHPLSCTAGSVTSLFRHGVCNLSHGLCHLLSQEPQTSSRTYSLTD

SEQ ID NO: 796777 - protein, 248 aa, Homo sapiens
MQPNPNLNVSKESLSPAKFDYKLKNIFRLHELPVSCVSMQPHKDILVSCGEDRLWKVLGLPKCNVLLTGFGHTDWLSDCCFHPSERCRCTLYGHTDSVNSIEFFPFSNTLLTSSADKTLSIWDARTGICEQSLYGHMHSINDAIFDPRGHMIASCDACGVTKLWDFRKLLPIVSIDIGPSPGNEVNFDSSGRVLAQASGNGVIHLLDLKSGEIHKLMGHENEAHTVVFSHDGEILFSGGSDGTVRTWS

SEQ ID NO: 796778 - protein, 268 aa, Homo sapiens
MQPNPNLNVSKESLSPAKFDYKLKNIFRLHELPVSCVSMQPHKDILVSCGEDRLWKVLGLPKCNVLLTGFGHTDWLSDCCFHPSERCRCTLYGHTDSVNSIEFFPFSNTLLTSSADKTLSIWDARTGICEQSLYGHMHSINDAIFDPRHKGLHEDDGAMLWDFPASRTGHMIASCDACGVTKLWDFRKLLPIVSIDIGPSPGNEVNFDSSGRVLAQASGNGVIHLLDLKSGEIHKLMGHENEAHTVVFSHDGEILFSGGSDGTVRTWS

SEQ ID NO: 796779 - protein, 154 aa, Homo sapiens
YYCELSDKCGTITHFLVCPQPWGLGQRTGVLAIFSQLPPCAGLRVLRSYLLGERVQARYEPGLAERVLVSSDTCSVLCSWFGLALLLRTPGLSLQATREGSLEQQHLPLPLADTSFRLTQRRSLGTATARPGLPRQLAEPMRRPQHPSDGCSSP

SEQ ID NO: 796780 - protein, 242 aa, Homo sapiens
MASSPWGCVCGLLLLLLPLLGTGPALGRGFPRPLENSEIPMIPGAHPKGSVGSEPQAFDVFPENPRADSHRNSDVRHAPAEEMPEKPVASPLGPALYGPKAAQGAQRERLPVTDDLQMAQGPSSHGWTGPLDSQELLEQEAVAPHPVGHPHLTFIPTTPRRQLRVATVPPSLQHEGQEGQWPPRDEGLKAKTKSRVPPTSPSDHQGPPHTLVSHSGTVKRPVLEGQGGFEEHLQEAAQGPHF

SEQ ID NO: 796781 - protein, 242 aa, Homo sapiens; identical to SEQ ID NO: 796780

SEQ ID NO: 796782 - protein, 416 aa, Homo sapiens
YDKAVQSYKDVFSYLPTDNKVMLELAQLYLLQGHLDLCEQHCAILLQTEQNHETASVLMADLMFRKQKHEAAINLYHQVLEKAPDNFLVLHKLIDLLRRSGKLEDIPAFFELAKKVSSRVPLEPGFNYCRGIYCWHIGQPNEALKFLNKARKDSTWGQSAIYHMVQICLNPDNEVVGGEAFENQGAESNYMEKKELEQQGVSTAEKLLREFYPHSDSSQTQLRLLQGLCRLATREKANMEAALGSFIQIAQAEKDSVPALLALAQAYVFLKQIPKARMQLKRLAKTPWVLSEAEDLEKSWLLLADIYCQGSKFDLALELLRRCVQYNKSCYKAYEYMGFIMEKEQSYKDAVTNYKLAWKYSHHANPAIGFKLAFNYLKDKKFVEAIEICNDVLREHPDYPKIREEILEKARKSLRP

SEQ ID NO: 796783 - protein, 371 aa, Homo sapiens
YDKAVQSYKDVFSYLPTDNKVMLELAQLYLLQGHLDLCEQHCAILLQTEQNHETASVLMADLMFRKQKHEAAINLYHQVLEKAPDNFLVLHKLIDLLRRSGKLEDIPAFFELAKKVSSRVPLEPGFNYCRGIYCWHIGQPNEALKFLNKARKDSTWGQSAIYHMVQICLNPDNEVVGGEAFENQGAESNYMEKKELEQQGVSTARNCCKDSVPALLALAQAYVFLKQIPKARMQLKRLAKTPWVLSEAEDLEKSWLLLADIYCQGSKFDLALELLRRCVQYNKSCYKAYEYMGFIMEKEQSYKDAVTNYKLAWKYSHHANPAIGFKLAFNYLKDKKFVEAIEICNDVLREHPDYPKIREEILEKARKSLRP

SEQ ID NO: 796784 - protein, 409 aa, Homo sapiens
YDKAVQSYKDVFSYLPTDNKVMLELAQLYLLQGHLDLCEQHCAILLQTEQNHETASVLMADLMFRKQKHEAAINLYHQVLEKAPDNFLVLHKLIDLLRRSGKLEDIPAFFELAKKVSSRVPLEPGFNYCRGIYCWHIGQPNEALKFLNKARKDSTWGQSAIYHMVQICLNPDNEVVGGEAFENQGAESNYMEKKELEQQGVSTAEKLLREFYPHSDSSQTQLRLLQGLCRLATREKANMEAALGSFIQIAQAEKDSVPALLALAQAYVFLKQIPKARMQLKRLAKTPWVLSEAEDLEKSWLLLADIYCQGSKFDLALELLRRCVQYNKSCYKAYEYMGFIMEKEQSYKDAVTNYKLAWKYSHHANPAIGFKLAFNYLKDKKFVEAIEICNDVSQQPWWGGPGVVVGKPA

SEQ ID NO: 796785 - protein, 77 aa, Homo sapiens
WAGGTGMVSSAEEQSCVPKSSGGDSSNAGPGLGLLPPCCMTCRESRLLCLSFPFRQTGARKGLPSQVCPLRSAVRWQ

SEQ ID NO: 796786 - protein, 99 aa, Homo sapiens
LNPKGSDFRTPRGMSPFALVEGRRARISRSVETPHPRYRIAGDLEAQPQYNTEQNSPPQCDFQSTRSASWSGRIYKHRTEARPPWSQRVPVLRKKTTRK

SEQ ID NO: 796787 - protein, 127 aa, Homo sapiens
SHSSDTYCEPYTSWCQDTYSQSKPKMQSLVQWGLDSYDYLQNAPPGFFPRLGVIGFAGLIGLLLTRGSKMKKLVYLPGFMRLAASLYYPQQTIVFAQVSGERLYDWSLRFVEGELSKARKCEEFTWN

SEQ ID NO: 796788 - protein, 102 aa, Homo sapiens
PGSQAKQAFENATVSSPVEGFTNHKVAIIRQDPGQGEGQPDCPFLYPCLGPGGILSRESLCFVPFSLSCLPASPPLPSCPRQKGCQKRQTHSTEVSVTKEAL

SEQ ID NO: 796789 - protein, 282 aa, Homo sapiens
AEAISVNETIVLVETRIRAMDKDAKKRIHNFSVINPVPGQAITQIFAVDNREDLQKWMEAFWQHFFDLSQWKHCCEELMKIEIMSPRKPPLFLTKEATSVYHDMSIDSPMKLESLTDIIQKKIEETNGQFLIGQREESLPPPWATLFDGNHQMVIQKKVLYPASEPLHDEKGKKRQAPLPPSDKLPFSLKSQSNTDQLVKDNWGKTSVSQTSSLDTKLSTLMHHLQKPMAAPRKLLPARRNRLSDGEHTDTKTNFEAKPVPAPRQKSIKDILDPRSWLQAQV

SEQ ID NO: 796790 - protein, 82 aa, Homo sapiens
SRSTETIFTGTCDSVAAMSGILKGKFEEVNGSSPCSSVQESDDEVFSCDSTESVDSVNRSVLMILPEKMRKYQQTENMFSEA

SEQ ID NO: 796791 - protein, 120 aa, Homo sapiens
DAVSLMSPSLECSGAISAHCNLRLLGSSDSPASASRVSGITAMRLHTQLIFVFSVETEFHHVGQAGLELLTSSDLPTLASQGVGITGVSHRTRPIHTILYHVVMKMKWEAACEILGTVLT

SEQ ID NO: 796792 - protein, 155 aa, Homo sapiens
SAPARDHLGKKRDPDIEEGEASLGRPATPGSPGPARGSRAVSCRHPGTGSPARSHSARSPLRDWVRSKGRGNLWAPRLVLPTRVSCLRFPAFPTLPGRGFGVPCSGPARSPPTGWLGSGRGGRQRGRETGVAPHALRAPRAAAPAQRPPVPDHAA

SEQ ID NO: 796793 - protein, 761 aa, Homo sapiens
MSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYPSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKELYASASQEVTGPLASAHQWVDMTDVTVWLNSTHASKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHALSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 796794 - protein, 210 aa, Homo sapiens
ERSDGVEADLRSRNCEQAQRYEAASTIYGPHALSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 796795 - protein, 174 aa, Homo sapiens
ACNFVTRGWCYVYYGMDLEPDSPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 796796 - protein, 67 aa, Homo sapiens
LSLFTDDMIAYLENPKDSSKKILDLINKSSKVSGYKINVRKPVALLYTNSNQAENQINYSTPLTTPA

SEQ ID NO: 796797 - protein, 104 aa, Homo sapiens
LTKNPGMALKTSLGSVQFMEQFCWPHLRSFCETCVGSWSIQMRQHHHQSSFPGSLPQETNLTLKVCKPQAPQKLDPTLSSCFFIESCGAQVPVEGSRRETSITV

SEQ ID NO: 796798 - protein, 41 aa, Homo sapiens
MAGSLAGNLQELSARYLSSSPSSLTPGPTIKKGPRKKRWTD

SEQ ID NO: 796799 - protein, 134 aa, Homo sapiens
ALHTPARTPPPQRAPAGTFRALHTPAHTPPPQHAPAGTSRALHTPDCTPPPQCAPAGTSRALHTPAHTPPPQHAWTLYIPACIPPPQCAPAGTFGVLHTPSPTQRPPQAPPPLYICIVRFGAHRCSDIGISSSA

SEQ ID NO: 796800 - protein, 80 aa, Homo sapiens
MPSQKRIFFYIVAVADAKKSREFNPNNSTAVLRKGICEYHLKNYAAALETFIGGQKLVQMLISVTGLKGVKKLRMAQNLR

SEQ ID NO: 796801 - protein, 41 aa, Homo sapiens
TGGPGGRAALSCGPETASERRPVLGRGLCRDCSRENVFIIP

SEQ ID NO: 796802 - protein, 67 aa, Homo sapiens
VALHPHQHLVWSVFWIFTILIEIHGSIRVVRAPLAPLCGYSPVPFSEATGQKPLYNTLPNSRILKET

SEQ ID NO: 796803 - protein, 148 aa, Homo sapiens
GCIVHRLEQHDSCPVCRKSLPGHNTATNTPAPGPTGMNCSSSCPPPPPARPVKRTPQVTPEPAWAGTHHCPLRLRLRGNRGDFPNHPQPGPHGTHRLGAPEAPVLAGQRYRPRLFQGRILDRPTGSLAREGVGHMVPSGAPSASPSFV

SEQ ID NO: 796804 - protein, 119 aa, Homo sapiens
MCPLNTAMLLETDCHFMWTQPLNRMCAFVSAAIPSSVIALLHFCWSQGRGVPANVRVVRPQPLPFYTVLGCLLACGGGRGSQYLCTVYCPEPAFIPNFSKIALKGGGRGSNIVLKGGTG

SEQ ID NO: 796805 - protein, 61 aa, Homo sapiens
MHYSKTIIYPCNAPGTAAFPFQSPHPVFPRRLHRPGQALNDSRCHCHFYKALFRVKSLFVS

SEQ ID NO: 796806 - protein, 101 aa, Homo sapiens
RLSTWLIRHLLYVSAQRCLSETFLIIIFRITVPTSYWELLTTPPTSSICFLHGLSNIHHVIICILFTVSPHVECKLPKDRDFDLFSLLRYQPGARIGPDRW

SEQ ID NO: 796807 - protein, 82 aa, Homo sapiens
QPEPPYLPTLFPATSQHPFLLQVGLNPLCSSRGSSTLILAQNISHPPDWASTLHGEPNHGKAGFHKPPCKPTDRRRLPSTTA

SEQ ID NO: 796808 - protein, 173 aa, Homo sapiens
PVADTENKENEVEEVKEEGPKEMTLDEWKAIQNKDWAKVEFNICKPNEGVDGQWKKGFVLHKSKSEEAHAEDSVMDHHFRKPANDITSQLEINFGDLAAQDVAAGEDEVDVGVVGAQTVAAGPTSQVLLLLMWMTQRHSQLWLNWMPEDNPGSFVNPSVQSFCMLKDSKRLRN

SEQ ID NO: 796809 - protein, 108 aa, Homo sapiens
WLSSSTVSRTHLCCSVLSLSIKNRHTDQWNRIEKPEISPHIYSELIFEKGTKNTHWGKNILFNKWCWETWIATCRRMELDSYLSPYTKINSKWIKDLNVRARNMKLFE

SEQ ID NO: 796810 - protein, 167 aa, Homo sapiens
QFVWGSHLARHQQTHTGERPYSCLKCEKTFGRRHHLIRHQKTHLHDKTSRCSECGKNFRCNSHLASHQRVHAEGKSCKGQEVGESPGTRKRQRAPPVPKCHVCTECGKSFGRRHHLVRHWLTHTGEKPFQCPRCEKSFGRKHHLDRHLLTHQGQSPRNSWDRGTSVF

SEQ ID NO: 796811 - protein, 783 aa, Homo sapiens
MVAKPPVMSFHFAQDLWPEQNIKDSFQKVTLRRYGKCEYENLQLRKGCKHVDECTGHKGGHNTVNQCLTATPSKIFQCNKYVKVFDKFSNSNRYKRRHTGNKHFKCKECSKSFCVLSQLTQHRRIHTRVNSYKCEECGKAFNWFSTLTKHKRIHTGEKPYKCEECGKAFNQSSQLTRHKIIHTEEKPNKCEECGKAFKQASHLTIHKIIHTGEKPYKYEECGKVFSQSSHLTTQKILHTGENLYKCKECGKAFNLFSNLTNHKRIHAGEKPYKCKECGRAFNISSNLNKQEKIHTGGKLNKCEECDKAFNRSLKLTAHKKILMEEKPYKCEECGKVFNQFSTLTRHKIIHTGEKPYKCKECGKAFNQSSNLTEHKKIHTAEKSYKCEECGKAFNQHSNLINHRKIYSGEKPYKCEECGKAFNRSSTLTRHKKIHTGEKPYKCEECDRAFSQSSNLTEHKKIHTGEKPYKCEECGKAFNRFSTLTKHKRIHTGEKPYKCEECGKAFNQSYQLTRHKIVHTKEKLNKCEEFGKAFKQSSHRTIHKIIHTGEKPYKCEEHGKVFNQSSNLTTQKIIHTGENLYKFEEHGKAFNLFSNITNHKIIYTGEKPHKCEECGKAYNRFSNLTIHKRIHTGEKPYQCAECGKAFNCSSTLNRHKIIHTGEKPYKCKECGKAFNLSSTLTAHKKIHTGEKPYKCEECGKAFNQSSNLTTHKKIHTSEKPYKCEECGKSFNQFSSLNIHKIIHTGEKPYKCGDYGRAFNLSSNLTTHKKIHTGEKPYKCEYGKT

SEQ ID NO: 796812 - protein, 142 aa, Homo sapiens
MQSLANFSINEMTENILTGRAVQLLRSYMSSLTHYTSNEKPIHGPVTTNAVLTFQAPLCIQHNLSSGLPLGHLLFHQCNYALQLQAPTDCINFQVSQTATFKQPVRFSKPPEVISTSLLNKQSGFCNGRHTHCMTIHPWTSC

SEQ ID NO: 796813 - protein, 142 aa, Homo sapiens; identical to SEQ ID NO: 796812

SEQ ID NO: 796814 - protein, 142 aa, Homo sapiens; identical to SEQ ID NO: 796812

SEQ ID NO: 796815 - protein, 142 aa, Homo sapiens; identical to SEQ ID NO: 796812

SEQ ID NO: 796816 - protein, 783 aa, Homo sapiens; identical to SEQ ID NO: 796811

SEQ ID NO: 796817 - protein, 783 aa, Homo sapiens; identical to SEQ ID NO: 796811

SEQ ID NO: 796818 - protein, 67 aa, Homo sapiens
YGRESIEFAGAFSRDHAEAAFGSSPGSASPNSRTISYFHSASVRSIYTNIPGQVGPSPLKNTQKFIL

SEQ ID NO: 796819 - protein, 296 aa, Homo sapiens
MTKTALLKLFVAIVITFILILPEYFKTPKERTLELSCLEVCLQSNFTYSLSSLNFSFVTFLQPVRETQIIMRIFLNPSNFRNFTRTCQDITGEFKMCSSCLVCESKGNMDFISQEQTSKVLIRRGSMEVKANDFHSPCQHFNFSVAPLVDHLEEYNTTCHLKNHTGRSTIMEDEPSKEKSINYTCRIMEYPNDCIHISLHLEMDIKNITCSMKITWYILVLLVFIFLIILTIRKILEGQRRVQKWQSHRDKPTSVLLRGSDSEKLRALNVQVLSAETTQRLPLDQVQEVLPPIPEL

SEQ ID NO: 796820 - protein, 296 aa, Homo sapiens; identical to SEQ ID NO: 796819

SEQ ID NO: 796821 - protein, 268 aa, Homo sapiens
MTKTALLKLFVAIVITFILILPEYFKTPKERTLELSCLEVCLQSNFTYSLSSLNFSFVTFLQPVRETQIIMRIFLNPSNFRNFTRTCQDITVLIRRGSMEVKANDFHSPCQHFNFSVAPLVDHLEEYNTTCHLKNHTGRSTIMEDEPSKEKSINYTCRIMEYPNDCIHISLHLEMDIKNITCSMKITWYILVLLVFIFLIILTIRKILEGQRRVQKWQSHRDKPTSVLLRGSDSEKLRALNVQVLSAETTQRLPLDQVQEVLPPIPEL

SEQ ID NO: 796822 - protein, 180 aa, Homo sapiens
KTFLHGSEFNRHQKIHTGERNYECKECGKTFFRGSELNRHQKIHTGKRPYECEECGKAFLWGSQLTRHQRMHTGEEPYVCKECGKSFIWGSQLTRHKKIHTDAEPYGCKKSSHIFSHHSYFTEQKIHNSANLCEWTDYGNTFSHESNFAQHQNIYTFEKSYEFKDFEKAFSSSSHFISLL

SEQ ID NO: 796823 - protein, 86 aa, Homo sapiens
KEASLNTSLPIHCRTNSNRGCFCSGTRWAPSAALTSGPCSLGPCGSASKWDPLSHTGSAGVPPALWELVTLSTVKGRGWRHRRSGS

SEQ ID NO: 796824 - protein, 70 aa, Homo sapiens
AARAKSGRLEPLSPRCGRELHGGAPAALGKMPRPELPLPEGWEEARDFDGKVYYIDHTNRTTSWIDPRDR

SEQ ID NO: 796825 - protein, 228 aa, Homo sapiens
AAARAKSGRLEPLSPRCGRELHGGAPAALGKMPRPELPLPEGWEEARDFDGKVYYIDHTNRTTSWIDPRDRYTKPLTFADCISDELPLGWEEAYDPQVGDYFIDHNTKTTQIEDPRVQWRREQEHMLKDYLVVAQEALSAQKEIYQVKQQRLELAQQEYQQLHAVWEHKLGSQVSLVSGSSSSSKYDPEILKAEIATAKSRVNKLKREMVHLQHELQFKERGFQTLKK

SEQ ID NO: 796826 - protein, 179 aa, Homo sapiens [sequence omitted]

SEQ ID NO: 796827 - protein, 167 aa, Homo sapiens
MTAGTVVITGGILATVILLCIIAVLCYCRLQYYCCKKSGTEVADEEEEREHDLPTHPRGPTCNACSSQALDGRGSLAPLTSEPCSQPCGVAASHCTTCSPYSSPFYIRTADMVPNGGGGERLSFAPTYYKEGGPPSLKLAAPQSYPVTWPGSGREAFTNPRAISTDV

SEQ ID NO: 796828 - protein, 167 aa, Homo sapiens; identical to SEQ ID NO: 796827

SEQ ID NO: 796829 - protein, 127 aa, Homo sapiens
LFPLSRHRCLLWKLPCSTSGPAAASHGAGTCVSTWSCLPCHSSWHAWLYAVAGPCTCSATHHSSLCAWPTLGGCRIQAGSMSQVQPASLSGQNELNRCKQYSGRKHQWTQRFPADEVTHQRSCDIYY

SEQ ID NO: 796830 - protein, 154 aa, Homo sapiens
MEIMPMNIVSIISPLIDVSPGRRGRLKNAGGGIRLAERVNRRADRNVLRREKGLALGRVTFPRAGRGSRVSAPARSEPGPAAVPGGVRRADDRKFPPGASQPAFRSRRFQAAAGGPSYANDPTSSAKPVKLLPRERAGLKVTNFSQSREREGSA

SEQ ID NO: 796831 - protein, 71 aa, Homo sapiens
WTLKITHITSPVPKWLFLWLTLAVSLPTRPMVSSVPMLCISTRPYTLSDLSEDPGTACAAPVNLRGAIRFA

SEQ ID NO: 796832 - protein, 177 aa, Homo sapiens
SSPRSMERQMTEHSLRIQGPLQHCSRSASPQTSRGTQAAPLPAPPRAQQRAELRVILQLFSEHKSGTAGMVQTTPRRRPLDKMTPKRKAREPHGTQRKGAGKARQCRTQAAPGLGGGQAGVVTTSGSSRKYRTFSRKLLGIMKNKSWAGLGEGQGLSLPAGSHGLAARPERGPGNQR

SEQ ID NO: 796833 - protein, 239 aa, Homo sapiens
LLPSHLALGSCLASRKQLHRGGEPRRISQLQSNSNTEDSAVATMGSVNSRGHKAEAQVVMMGLDSAGKTTLLYKLKGHQLVETLPTVGFNVEPLKAPGHVSLTLWDVGGQAPLRASWKDYLEGTDILVYVLDSTDEARLPESAAELTEVLNDPNMAGVPFLVLANKQEAPDALPLLKIRNRLSLERFQDHCWELRGCSALTGEGLPEALQSLWSLLKSRSCMCLQARAHGAERGDSKRS

SEQ ID NO: 796834 - protein, 239 aa, Homo sapiens; identical to SEQ ID NO: 796833

SEQ ID NO: 796835 - protein, 163 aa, Homo sapiens
MDCELQSSLQWPLFFPVDASCSGVFRPRPVSPSSLLDTAISEEARQGPGLEEEQDTQESLPSSTGRRHTLAEVSTRLSPLTAPCIVVSPSTTASPAEGTSSDSCLTFSASKSPAGLSGTPATQGLLGACSPVRLASPFLGSQSATPVLQAQGGLGGAVLLPVS

SEQ ID NO: 796836 - protein, 85 aa, Homo sapiens
IQKPRDGNSASSAGALIDLGSARGSSQGSPEPSSVGVLLTLHDRMLWVGLCTCVFVHTEETSVGGDQGHFYKQKSCSISITQLVG

SEQ ID NO: 796837 - protein, 68 aa, Homo sapiens
GNQIWICPGCNKPDDGSPMIGCDDCDDWYHWPCVGIMTAPPEEMQWFCPKCANKKKDKKHKKRKHRAH

SEQ ID NO: 796838 - protein, 68 aa, Homo sapiens; identical to SEQ ID NO: 796837

SEQ ID NO: 796839 - protein, 68 aa, Homo sapiens; identical to SEQ ID NO: 796837

SEQ ID NO: 796840 - protein, 149 aa, Homo sapiens
AAPSSWPRGSLGDSVQYSPRGLCCAKAAPADAAAPVDGALPWEQSWNSSKRIKDNCVGRLPRFVAVPPQTSEMNTALETRRIQVAEAFRCCVNPSRAIPDAPQDSAERTAVSLGGPGLLLPPLLWAEHQGSASVFFSQLVQERTLKLFL

SEQ ID NO: 796841 - protein, 684 aa, Homo sapiens
MLKQARRPLFRNVLSATQWKKVKITRLVQISGASLAEKQEKHQDFLIQRQTKTKDRRFNDEIDKLTGYKTKSLLCMPIRSSDGEIIGVAQAINKIPEGAPFTEDDEKVMQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSSPASVMVAKEDRN

SEQ ID NO: 796842 - protein, 490 aa, Homo sapiens
MSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSSPASVMVAKEDRN

SEQ ID NO: 796843 - protein, 684 aa, Homo sapiens; identical to SEQ ID NO: 796841

SEQ ID NO: 796844 - protein, 934 aa, Homo sapiens [sequence omitted]

SEQ ID NO: 796845 - protein, 574 aa, Homo sapiens
MYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSSPASVMVAKEDRN

SEQ ID NO: 796846 - protein, 144 aa, Homo sapiens
MLKQARRPLFRNVLSATQWKKVKITRLVQISGASLAEKQEKHQDFLIQRQTKTKDRRFNDEIDKLTGYKTKSLLCMPIRSSDGEIIGVAQAINKIPEGAPFTEDDEKVMQMYLPFCGIAISNAQLFAASRKEYERSRSYVRDVY

SEQ ID NO: 796847 - protein, 45 aa, Homo sapiens
MPVVRPEVYRDSMAWMATYMAGVLKVSNMIWVIFSRLALGFRGAS

SEQ ID NO: 796848 - protein, 48 aa, Homo sapiens
PYRGNREKMTQIFETFNTPATYMAGVLKVSNMIWVIFSRLALGFRGAS

SEQ ID NO: 796849 - protein, 113 aa, Homo sapiens [sequence omitted]

SEQ ID NO: 796850 - protein, 153 aa, Homo sapiens
ASAICEAADKEEPPSQKKRVDTWPAGQPGTNPCHRTTWTRLKCTAATPSRAHSWPPTFEVCDSILNIGPCTNAAMGEPAFLSEEFQNNPEPDLEIVVCSSHRKNGALSVLQKSIQPQVVTTFELPGCYDMWTVIALVPKEEKENPKGEGTEQE

SEQ ID NO: 796851 - protein, 69 aa, Homo sapiens
HAGNAAMDKTARLCPHRTQSPVVESDPSQDNDDRGGSTGMGDPRGLWEHKGGSPTQPGSQGGLPGGGGT

SEQ ID NO: 796852 - protein, 160 aa, Homo sapiens
IPEKGVSIKSFPHIMQKSQEPFAQFIAQLQQSVRHQIPHTAPAKMLTLTLAFENANADCKCALAPVRCTNSLGNFLKACQDVGTELHRSTVLAQVIANLVVNKSEKGQGLSPKVGKCYNCGKIGHFKKEYHQTSGQKGSYNAIPPPPPRPAPPNTHTQKK

SEQ ID NO: 796853 - protein, 140 aa, Homo sapiens
ALGPAPPEARGDPTAGCLRPADSFTLRKQAGARRRPALGAQQTRGPARPLDLHREEEMEMGSPPTKEGGEGMAAMPRCRDRSRGPRAPLGPLEGPACASLSLCHFHWPYRATTAETACVTPGNRVLLDESCSKLGGKFTG

SEQ ID NO: 796854 - protein, 129 aa, Homo sapiens
MGFTTPAGENHLSSDCGPLHGPQLWEALGATPQPYFSFSLSPHTLIPSCVLFALCGHFTEKVDSAFLSRSTVFCPLTPSLTSSEPTSSCAQSVVSFLCLSSALRLPCPSCPFVPSAGLLPGMFHLTLSL

SEQ ID NO: 796855 - protein, 105 aa, Homo sapiens
MAHCSLDLSGSGDPPTSTSQVARTIGACHHVQLIFVFFGETGFHHVAPLVLELLDSSDPPTLASQSGGNRHEPPHRALKHIFLKHIWLFSFYFHQNGHEETMDQI

SEQ ID NO: 796856 - protein, 107 aa, Homo sapiens
THIHTHTHTHTHTHILFCREQDGNNLSVPMAGINHPLTEKKLEGISENYISFLHYERKHLKCLKHKRVVCWISISEDSHNHHMGQEIEHCKSPVCSFSYTLKINTTQ

SEQ ID NO: 796857 - protein, 114 aa, Homo sapiens
HWPIHHPGRLSTCRMRHRGHGRLSHPRPSLCPVFPRYPFLPSLPSQILSWSAAGCSATSVKPWGRPCRPSEGYSKDATVTPPSGPPHPGTGTGTVLCGSQHFTHLYALLQNNKH

SEQ ID NO: 796858 - protein, 135 aa, Homo sapiens
EPWQALQLLLAILLTLMALPYQARKKTFLSVHEVMAVENYAKDSLQWITDQYNKESDDKYHFRIFRVLKVQRQVTDHLEYHLNVEMQWTTCQKPETTNCVPQERELHKQVNCFFSVFAVPWFEQYKILNKSCSSD

SEQ ID NO: 796859 - protein, 100 aa, Homo sapiens
EPWQALQLLLAILLTLMALPYQARKKTFLSVHEVMAVENYAKDSLQWITDQYNKESDDKYHFRIFRVLKVQRQQVNCFFSVFAVPWFEQYKILNKSCSSD

SEQ ID NO: 796860 - protein, 361 aa, Homo sapiens
SHGHLSRPFLLEPARGACSRDTFLSASPRLPRPRQAASLAHRPEKSAPGADCPSGRRAAALDVRGPLWAGRGASALPSSSRVRSYPLGSRGTARGPVRSRADRSARQSGLAAANGARARTRLGSTFQSSGVANGTGTRAGGRGAAAAGRFPAQVPSAHQPSASGGAAVAPAAPRSCFLGGVASGARAAQSSFSIPNSSSGPQDSQDSVHSSPEDGGGGGQHRPVGGSPGGPRLVIGSLPAHLSPRMFGDASKIWCHDSDWGTSLGDQSLSSCSLLHEKDRPTTSGPQTDQPKEHFTNFKSETKVKRFICEPKTPAPVTESGRVFPWCLTTWGCLHDYSPMFQRCLTTEGCLSWSFTLSGPH

SEQ ID NO: 796861 - protein, 134 aa, Homo sapiens
KCDCSFQKRLWNRGPNKRMPGLLTQTHSNGIRTCLPLKVKADVCPPRKPLSIKASLTIIPGLQRASAFQECQLLSHQCVFFLKFASQGMALLFKFRCTRQVQKTRVKMRHQQPHTEDDSFSSSPLHKQAWYSSI

SEQ ID NO: 796862 - protein, 118 aa, Homo sapiens
KCDCSFQKRLWNRGPNKRMPGLLTQTHSNGIRTCLPLKVKADVCPPRKPLSIKASLTIIPGLQRASAFQECQLLSHQCVFFLKGSRSNTLLGDAAEARGLPDASQLNQQSFPLIALLD

SEQ ID NO: 796863 - protein, 74 aa, Homo sapiens
LLMHLSDKKSENVKLKTEDAQQLPESSPPRPALRDGRLPKRNRWWKSHVSLPLEGGTGQGRFGFRISPHLGAGR

SEQ ID NO: 796864 - protein, 110 aa, Homo sapiens
MRCGSWRPSWAPGGLTCASCGCPQTWAPRLACSPLLGALRQLPRTEELQQLLFINNAGSPGDVSKGFVDLGDSTQVNKDWALNLTSMLSLPDLQRLEGLTNQSWPQQNCG

SEQ ID NO: 796865 - protein, 219 aa, Homo sapiens
MVPDRQNSCPRLASAPPKGSPPLVKPLAPQRPHGVPPQARALAPKESHSDVFEMGLVPGPVLLPPGAGQPQKEDKSAWKDNRTTEPSGRCSSELGRRLDPPKVILIALTDKPVLGCRPEYCAPRVRRRKHPGLLFWPLCSGVNFVYCSLVQRGYGTRGCETQKWLGTQKGCRPGTCDLMGGGRRERNRQTWDRFGEAEREESEIAKGRCYSDFCVLCDK

SEQ ID NO: 796866 - protein, 118 aa, Homo sapiens
EGVPLSHCLGIWAWNLGHRSMMCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 796867 - protein, 147 aa, Homo sapiens
MQPLPSHSERGFVRWLGGIGQKWILQAELKAPRASAVYPSPRHLCSHRSMMCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 796868 - protein, 118 aa, Homo sapiens
TRGSTHASGVCLCHLVCHRSMMCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 796869 - protein, 117 aa, Homo sapiens
RYRRWKLGDDIDLIVRCEHDGVMTGANGEVSFINIKTLNEWDSRHCNGVDWRQKLELLHKELPSFVGEKVDEEGLKKLMGSLDENSDQQVDFQEYAVFLALITVMCNDFFQGCPDRP

SEQ ID NO: 796870 - protein, 122 aa, Homo sapiens
RLLLLNARSCRPWVCLCHLVCHRSMMCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 796871 - protein, 98 aa, Homo sapiens
MMCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 796872 - protein, 138 aa, Homo sapiens
MCSSLEQALAVLVTTFHKYSCQEGDKFKLSKGEMKELLHKELPSFVGHSREPCAVRAFRVHLFNPVIGDLRNQSPEGKSDCPKITQQLEKVDEEGLKKLMGSLDENSDQQVDFQEYAVFLALITVMCNDFFQGCPDRP

SEQ ID NO: 796873 - protein, 77 aa, Homo sapiens
MCSSLEQALAVLVTTFHKYSCQEGDKFKLSKGEMKELLHKELPSFVGEKVDEEGLKKLMGSLDENSDQQWVVSADPL

SEQ ID NO: 796874 - protein, 117 aa, Homo sapiens
VSSPCGGEAERKQVHSHRSMMCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 796875 - protein, 118 aa, Homo sapiens; identical to SEQ ID NO: 796866

SEQ ID NO: 796876 - protein, 147 aa, Homo sapiens; identical to SEQ ID NO: 796867

SEQ ID NO: 796877 - protein, 118 aa, Homo sapiens
VDSACSRELHIMDLWQTRWQRQTQEGEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 796878 - protein, 113 aa, Homo sapiens
MQPLPSHSERGFVRWLGGIGQKWILQAELRPQEPQQCTHHLAPLQPQIHDVQFSGAGAGCAGHYLPQVLGLKKLMGSLDENSDQQVDFQEYAVFLALITVMCNDFFQGCPDRP

SEQ ID NO: 796879 - protein, 98 aa, Homo sapiens; identical to SEQ ID NO: 796871

SEQ ID NO: 796880 - protein, 98 aa, Homo sapiens; identical to SEQ ID NO: 796871

SEQ ID NO: 796881 - protein, 98 aa, Homo sapiens; identical to SEQ ID NO: 796871

SEQ ID NO: 796882 - protein, 109 aa, Homo sapiens
IKYSSIARVRLPTFCNTGNSDLQKEVSHLCIKSELGRDIPQRLYIYSSLPLSGLSKDLRMFLRFLHSSYYHIQTEYQNAGFLEGHLVSRNFLVSSLKNSLAYSPLMFWQ

SEQ ID NO: 796883 - protein, 97 aa, Homo sapiens
RKSRNCTKNRKDGLAPVNSNNNQVSSSSHLQSDTKDYSLPSASWSPIMVRLYNEFMEKTVDGSWTRLPGCWCSVQFLKEADLTKIAKAVPAIFLQMK

SEQ ID NO: 796884 - protein, 207 aa, Homo sapiens
RPLRGDQEAGAALDNQHAEMSEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHALDKLSTQHLYHPTQVEIVQSNVVFDISSLMLYGTQAVPVRLKILLDRLFSVLKQEEVLHILHGLGWTLRDYVRGYILQDAAGRGA

SEQ ID NO: 796885 - protein, 171 aa, Homo sapiens
RPLRGDQEAGAALDNQHAEMAHLGPTPPPHSLNYKSEDRLSEQDWPAYFKVPCCGVDTSQIESEEAEVDVRERETQRDREPKRARDLTLRDSCTDNSMQFGTRTTTAEPGFMGTWQNADTNLLFRMSQQAIRCTLVNCTCECFQPGKINLRTCDQCKHGWVAHETLKSCLQ

SEQ ID NO: 796886 - protein, 68 aa, Homo sapiens
IVPIFMSCTFPIFICYTVAIFISYMAPIFISHTFPILYIPYLHVIYGPIFRPFMVPIFIPYTFLIFMS

SEQ ID NO: 796887 - protein, 101 aa, Homo sapiens
TKASQELIVLQECVQTNIKEDGSNSSHLPPSPLIKKCSPTATVLEKKPGTGRGKDLCDLNLAFLAQSPIWHFFLDAHGSGIVLYPAWAVASALYSLLLYLP

SEQ ID NO: 796888 - protein, 71 aa, Homo sapiens
GIDNEWSGKLQRTENDSVKDFQEKMAASTHISDTPLSEMHYQMSQYFFAKIRTCKIGQFSCRIRHETESRS

SEQ ID NO: 796889 - protein, 107 aa, Homo sapiens
MLMPKNRIAIYELLFKEGVMVAKKDVHMPKHRELADKDVPNLHVMKAMQPLKSRGYVKEQFAWRHFHWYVTNEGIQYLRDYLHLPRRLCLPLYAAAVQRLEVLSLKV

SEQ ID NO: 796890 - protein, 66 aa, Homo sapiens
FQGLRSFAVVNWYRHPITTTSFIGLQGISVWKSNGVQSTSLIAKDCQNYKTCCGALTCQKPLEKEV

SEQ ID NO: 796891 - protein, 71 aa, Homo sapiens
TRRRRKVAQAVDRAEKATSGLLEFAGGALQTLFACLSPTEAAEQQRLLSVTSSGSFIPEGHLPDASRSSPL

SEQ ID NO: 796892 - protein, 71 aa, Homo sapiens; identical to SEQ ID NO: 796891

SEQ ID NO: 796893 - protein, 139 aa, Homo sapiens
MVIYRCTSWQRDLQVASSPFSRQAVPQDRVLLCHPGWSTMYNGVIIADCSLDLLGLSHPPALASCVAGTTGTHHRAQLAVVILSALSACPSWRLCQVPGPHTVNRAVSPQAHQPLVSTYFDFCPSERQKLNKTKEFGCS

SEQ ID NO: 796894 - protein, 262 aa, Homo sapiens
AAWRGSDRLAWHFWLSGPPFADWKPRAILLGGCGRGSSSLLMASWGGEKRGGAGGSPKPAVYATRKTPSVGSQEDQWYLDYPGDQWSLGFSYSWWKNSVGSESKHGEGALDQLQHDVRLEDLGELHRAARSGDVPGVEHVLAPGDTGVDKRDRKKSIQQLVPEYKEKQTPESLPQNNNPAAPSQAEGGEGGVACGTVEQMTWLCSLPHAVGGGDGDHSSTGAVGGHPRGPGEYCHLHEQRVHHHIFARGKRKGKNHVSNVVR

SEQ ID NO: 796895 - protein, 120 aa, Homo sapiens
MGSSFSWRWLLCLEPEACPLGGMPPQKEASYHKGQHHVLPSLLLNRLFLNEKDFGSNQQFGFLLFTSMSQSSLLPGSPTKPNENKFNVCPLSLAWEFLRSTQNHGLSVTPKTILPNSTCS

SEQ ID NO: 796896 - protein, 73 aa, Homo sapiens
PSGRGWADHSFPGLRPCLLGFCGDFVVVWGFVSFQRLQALGVRKEAAKLRKRRSSSHSKTKLKVTLYCLQSAQ

SEQ ID NO: 796897 - protein, 163 aa, Homo sapiens
MERLCSDGFAFPHYYIKPYHLKRIHRAVLRGNLEKLKYLLLTYYDANKRDRKERTALHLACATGQPEMVHLLVSRRCELNLCDREDRTPLIKAVQLRQEACATLLLQNGADPNITDVFGRTALHYAVYNEDTSMIEKLLSHGTNIEECSKCLPQKQRAGEGYK

SEQ ID NO: 796898 - protein, 151 aa, Homo sapiens
MERLCSDGFAFPHYYIKPYHLKRIHRAVLRGNLEKLKYLLLTYYDANKRDRKERTALHLACATGQPEMVHLLVSRRCELNLCDREDRTPLIKAVQLRQEACATLLLQNGADPNITDVFGRTALHYAVYNEDTSMIEKLLSHGTNIEECSKV

SEQ ID NO: 796899 - protein, 185 aa, Homo sapiens
MERLCSDGFAFPHYYIKPYHLKRIHRAVLRGNLEKLKYLLLTYYDANKRDRKERTALHLACATGQPEMVHLLVSRRCELNLCDREDRTPLIKAVQLRQEACATLLLQNGADPNITDVFGRTALHYAVYNEDTSMIEKLLSHGTNIEECSKNEYQPLLLAVSRRKVKMVEFLLKKKANVNAIDYLG

SEQ ID NO: 796900 - protein, 134 aa, Homo sapiens
MFRKGSLFNPWYWENWQDVCRNWTPFFHHMPKLIQDALKTLKPKTIKIPEENLGSTILDMGTGKDFMTETPKAMATKAKIDKWDLIKLRSFCTTKETSIRANRQPTEWEKIFANYASHKGLISGIYEEFKHICK

SEQ ID NO: 796901 - protein, 71 aa, Homo sapiens
WSQLPGVESVQFLVGQAILFSPPSADAGVRLAQLGTFKGLSELQENKNLKWIESTGSGVPADLPGQDGRRT

SEQ ID NO: 796902 - protein, 325 aa, Homo sapiens
LGSRCERPPCPRTALSAHRRASRAGPSTSAPRGRTEAASSAAGCGADPGDEMTTSTLQKAIDLVTKATEEDKAKNYEEALRLYQHAVEYFLHAIKYEAHSDKAKESIRAKCVQYLDRAEKLKDYLRSKEKHGKKPVKENQSEGKGSDSDSEGDNPEKKKLQEQLMGAVVMEKPNIRWNDVAGLEGAKEALKEAVILPIKFPHLFTGKRTPWRGILAVRTPWHREILPGQSRGNRGQQSTFLLCVLLRSDVQVAGGRVKKLVKNLFELARQHKPSIIFIDDGGFPLRVRNENESEAAGGSKRSSWSRCRVGNNNDGTLVLGATNIP

SEQ ID NO: 796903 - protein, 141 aa, Homo sapiens
LGSRCERPPCPRTALSAHRRASRAGPSTSAPRGRTEAASSAAGCGADPGDEMTTSTLQKAIDLVTKATEEDKAKNYEEALRLYQHAVEYFLHAIKYEAHSDKAKESIRAKCVQYLDRAEKLKDYLRSKEKHGKLCLKDRVT

SEQ ID NO: 796904 - protein, 113 aa, Homo sapiens
TLCFVIVMTSGQMWTYIRGEPYVQRDPHTGHKHYISKFSQAQFAAETFIISLFNMCVSLGMVLLDKAATSTMNIRKRKMMCLAGMCLVAIFFSRLLSLFRFKVPDYPYSFVWD

SEQ ID NO: 796905 - protein, 103 aa, Homo sapiens
EEEGKPGSLPRSGGVCVGLRCVLAWVEGGDVHLLESGVLRPRLEAWPRAGAWSLGVGGGGRGGGRPLLGGLLSARPRPRQAAYLHGERRRPMGARGRACWDRA

SEQ ID NO: 796906 - protein, 68 aa, Homo sapiens
FHGSDCPSVMNEGDSSLATDLQEDVEENPSPTVEENNVVVKKQGPNLHNWSGDWSFWNALLSGSMKWN

SEQ ID NO: 796907 - protein, 165 aa, Homo sapiens
PVTRSARWRWARGGAVRCARGGAAAAEGAAMEGAPTVRQVMNEGDSSLATDLQEDVEENPSPTVEENNVVVKKQGPNLHNWSGDWSFWISSSTYKDRNEEYRRQFTHLPDTERLIADYACALQRDILLQGRLYLSENWLCFYSNIFRWETTVRHFAFDLLIQIIA

SEQ ID NO: 796908 - protein, 333 aa, Homo sapiens
PVTRSARWRWARGGAVRCARGGAAAAEGAAMEGAPTVRQVMNEGDSSLATDLQEDVEENPSPTVEENNVVVKKQGPNLHNWSGDWSFWISSSTYKDRNEEYRRQFTHLPDTERLIADYACALQRDILLQGRLYLSENWLCFYSNIFRWETTISIALKNITFMTKEKTARLIPNAIQIVTESEKFFFTSFGARDRSYLSIFRLWQNVLLDKSLTRQEFWQLLQQNYGTELGLNAEEMENLSLSIEDVQPRSPGRSSLDDSGERDEKLSKSISFTSESISRVSETESFDGNSSKGGLGKEESQNEKQTKKSLLPTLEKKLTRVPSSLDLNMYLSL

SEQ ID NO: 796909 - protein, 68 aa, Homo sapiens
MGPALGASKKFSKHHLRGAAGAPDGQRCTTGPQRAPQEPPGPRRRRGTSHPIKKPPGGTRAFWTTPEG

SEQ ID NO: 796910 - protein, 84 aa, Homo sapiens
PELATGAHSPTALFASDGQMVHRRPPTATLLGDVVLRIFKHQQKLQLLKRTVPKGLAELVRRARLLANDYSGSRIPSRAGYQGQ

SEQ ID NO: 796911 - protein, 117 aa, Homo sapiens
NGLSCPPATTDWLSEERLWSPLHGFLVQTQISFPLAAFLKLIKSWLKKASSCQQDEKTECREAQGQKQGCQLHEVGDLACCIHFYLLEQRLAQSLSNSNGCKEKEEEVEKRNAVSSA

SEQ ID NO: 796912 - protein, 409 aa, Homo sapiens
AAGLPAVVTGRRCHLQHSVKNMLAAFISRVLRRVAQKSARRVLVASRNSSNDATFEIKKCDLYLLEEGPPVTTVLTRAEGLKYYRMMLTVRRMELKADQLYKQKFIRGFCHLCDGQEACCVGLEAGINPSDHVITSYRAHGVCYTRGLSVRSILAELTGRRGGCAKGKGGSMHMYTKNFYGGNGIVGAQGPLGAGIALACKYKGNDEICLTLYGDGAANQGQIAEAFNMAALWKLPCVFICENNLYGMGTSTERAAASPDYYKRGNFIPGLKVDGMDVLCVREATKFAANYCRSGKGPILMELQTYRYHGHSMSDPGVSYRTREEIQEVRSKRDPIIILQDRMVNSKLATVEELKEIGAEVRKEIDDAAQFATTDPEPHLEELGHHIYSSDSSFEVRGANPWIKFKSVS

SEQ ID NO: 796913 - protein, 82 aa, Homo sapiens
RSFRAQTPSPRPSASPLPGAGSLLGPLRSSAFQAKGKSEPWRTVRRGAETWMRPAISFPAPAFSAHPGSFPPKPLTYKYSAS

SEQ ID NO: 796914 - protein, 136 aa, Homo sapiens [sequence omitted]

SEQ ID NO: 796915 - protein, 353 aa, Homo sapiens [sequence omitted]

SEQ ID NO: 796916 - protein, 353 aa, Homo sapiens [sequence omitted]

SEQ ID NO: 796917 - protein, 100 aa, Homo sapiens
GDEGKEEEEMVAENRRRKTAGVLPVEVQPLLLSDSPECLVLGGGDTNPDLLRHMPTDRGVGDQVRRTWNLKLQTFGILPRCKELTSFIAFVYFSRLRYHC

SEQ ID NO: 796918 - protein, 130 aa, Homo sapiens
ISQITNLNYATNLTHLYLQNNCISCIENLRSLKKLEKLYLGGNYIAVIEGLEGLGELRELHVENQRLPLGEKLLFDPRTLHSLAKSLCILNISNNNIDDITDLELLENLNQLIAVDNQLLHVKESLFEAI

SEQ ID NO: 796919 - protein, 229 aa, Homo sapiens
ISQITNLNYATNLTHLYLQNNCISCIENLRSLKKLEKLYLGGNYIAVIEGLEGLGELRELHVENQRLPLGEKLLFDPRTLHSLAKSLCILNISNNNIDDITDLELLENLNQLIAVDNQLLHVKDLEFLLNKLMKLWKIDLNGNPVCLKPKYRDRLILVSKSLEFLDGKEIKNIERQFLMNWKASKDAKKISKKRSSKNEDASNSLISNFKTMHHIVPVYYPQESLFEAI

SEQ ID NO: 796920 - protein, 185 aa, Homo sapiens
ISQITNLNYATNLTHLYLQNNCISCIENLRSLKKLEKLYLGGNYIAVIEGLEGLGELRELHVENQRLPLGEKLLFDPRTLHSLAKSLCILNISNNNIDDITDLELLENLNQLIAVDNQLLHVKDLEFLLNKLMKLWKIDLNGNPVCLKPKYRDRLILVSKSLGNFKTMHHIVPVYYPQESLFEAI

SEQ ID NO: 796921 - protein, 248 aa, Homo sapiens
ISQITNLNYATNLTHLYLQNNCISCIENLRSLKKLEKLYLGGNYIAVIEGLEGLGELRELHVENQRLPLGEKLLFDPRTLHSLAKSLCILNISNNNIDDITDLELLENLNQLIAVDNQLLHVKDLEFLLNKLMKLWKIDLNGNPVCLKPKYRDRLILVSKSLEFLDGKEIKNIERQFLMNWKASKDAKKISKKRSSKNEDASNSLISNFKTMHHIVPVYYPQVGKPKLAFFSEIQRYPVNANASPESS

SEQ ID NO: 796922 - protein, 125 aa, Homo sapiens
ISQITNLNYATNLTHLYLQNNCISCIENLRSLKKLEKLYLGGNYIAVIEGLEGLGELRELHVENQRLPLGEKLLFDPRTLHSLAKSLCILNISNNNIDDITDLELLENLNQLIAVDNQLLHVKVV

SEQ ID NO: 796923 - protein, 75 aa, Homo sapiens
IDKEEVKLLLFADNMIIYLENPKASSKKLLELINEFTKVSGYKINVHKSVALLYTNSHQAENQIKNSTPFTIAAK

SEQ ID NO: 796924 - protein, 95 aa, Homo sapiens
TCPIGGERRGFLTQLPQTAANSDHSGRVCLLFTPPQLQTMTFSQTSSSNLTLAPSTILYTGNKVLFNEWNFSVHEKAQYLHIQFPLSNVCTRIAN

SEQ ID NO: 796925 - protein, 99 aa, Homo sapiens
VETVSPEGRGEKRPRPDREETLVTQIDEPPSYEEALKQGLPTTRPIAPMATGVLGQHTPVTLDLPPPADTQQKPVLPGPSAVVVTRPSRASLRRAASGP

SEQ ID NO: 796926 - protein, 95 aa, Homo sapiens
LGAKNPGSGNFGQRMRARDAPSQTHTHFSPGLGKSPKAAPSAGKQTLLTEGKDSSIPPALPAATAIDPSFTRGSCNSPAARVGMDFGPWPLGMQR

SEQ ID NO: 796927 - protein, 134 aa, Homo sapiens
HWEGGRWGTIWGFSFPLPQPPPRCQSDLPRLWFPARPIFPLLPEPPTACEINRASASASLGGSGLWALGSGLRVQGRVGTQAVLAQLVPWVTGPHPDPTGVPLTVPASRPLCSARNTSSPHPFHPGKPHPSFKA

SEQ ID NO: 796928 - protein, 86 aa, Homo sapiens
GQQDQATVNSGSASAGRHQLPAARGLALWGSAPCTVSASAGLYGDPAGIPQAGKSLSSPLYTRGNRSLKLVVTFGRADGTMLAVWL

SEQ ID NO: 796929 - protein, 107 aa, Homo sapiens
MSFLFALVPLCLHRGDAGLPGAGAVFTVGLHSQPRIPEFRKPPILRSLPVNPANFSYGGRSYLYYPGQESNLLSASEEDTNLAVQMSLKRESWITHGELPPTPATIF

SEQ ID NO: 796930 - protein, 74 aa, Homo sapiens
MGLVPLEKGLMYPVCPLPLLPREDTEKVPSMRNRPSSDTRSVGALIFNFLASKTVSNTFLLFINDPVCNGGIGK

SEQ ID NO: 796931 - protein, 67 aa, Homo sapiens
YNSTIYRSLEKEDVFTIYTYLIQITGGFQRLRGKAPESKHRTSLVLSVPIAKWPPSKAAALFTPRAM

SEQ ID NO: 796932 - protein, 58 aa, Homo sapiens
MALCRRSYPLHSATSWSLIAEVLVLTLNQNAEPALCSRGSPRTAPTPVKGEPFPGPRR

SEQ ID NO: 796933 - protein, 122 aa, Homo sapiens
MWAEHSDSEAAESGKPSPGKCKHQEQDRKIIHAKRNLRNKFSPETGHGNSPPVFLKKCRLNQHLPTPGKTQELRIPGISAGLLGRAELGWSHGFWADSRFSPAFATCDGWRVSEDDSSVLSL

SEQ ID NO: 796934 - protein, 553 aa, Homo sapiens
MAFSELLDLVGGLGRFQVLQTMALMVSIMWLCTQSMLENFSAAVPSHRCWAPLLDNSTAQASILGSLSPEALLAISIPPGPNQRPHQCRRFRQPQWQLLDPNATATSWSEADTEPCVDGWVYDRSIFTSTIVAKWNLVCDSHALKPMAQSIYLAGILVGAAACGPASDRFGRRLVLTWSYLQMAVMGTAAAFAPAFPVYCLFRFLLAFAVAGVMMNTGTLLMEWTAARARPLVMTLNSLGFSFGHGLTAAVAYGVRDWTLLQLVVSVPFFLCFLYSWWLAESARWLLTTGRLDWGLQELWRVAAINGKGAVQDTLTPEVLLSAMREELSMGQPPASLGTLLRMPGLRFRTCISTLCWFAFGFTFFGLALDLQALGSNIFLLQMFIGVVDIPAKMGALLLLSHLGRRPTLAASLLLAGLCILANTLVPHEMGALRSALAVLGLGGVGAAFTCITIYSSELFPTVLRMTAVGLGQMAARGGAILGPLVRLLGVHGPWLPLLVYGTVPVLSGLAALLLPETQSLPLPDTIQDVQNQAVKKATHGTLGNSVLKSTQF

SEQ ID NO: 796935 - protein, 107 aa, Homo sapiens
MPLSILLGRSQAPVSSGEKDKSSPGRRQLRAGPCYSARALNTPGDATIRCACSVTQGAEAKGRSSAVKAECISEHCTQHRNDQLSPSQLTGLVCSKFSPAPLLLPTR

SEQ ID NO: 796936 - protein, 70 aa, Homo sapiens
WQGSKALGQEMLVESWKTMWGTGSGHRMVIVLLQDLDMDGEKQRRTFQVCPTGHAHHTLPALSRRPVRNT

SEQ ID NO: 796937 - protein, 218 aa, Homo sapiens
SFLFCVRPYFLDSLVFSLSFSFLALMEGPFTSCFWFSPESGIQNSGFCSKNSSYPTFSFAPPTLEGSSVLAFSALLNSHAGLPSYKIWLVFLWEVSGLILFLFLIIILKFLLVFLRQSETLSFKGNGCLSDLILNVDSTIRNPFWKYLIVVSLGGCCLVCTWLMYTAEFIAGPELGRFSIHCGPLVKSEALYLAGFWECILAFGCTSNVISSVLAERL

SEQ ID NO: 796938 - protein, 81 aa, Homo sapiens
AAPGITRSIRNCGGWHFHWKACGCRWKCSPAGLVTEPPGSSDSGVLSPYPSLAAEPGREAMSGTEGKLPTSPAFRLQALDK

SEQ ID NO: 796939 - protein, 73 aa, Homo sapiens
LERKPMERSCAGRKHEVIQMTKRLHAEKSTRHCHRSSVSGVVLSIMLMPRDHGTVPLFPRATANRKIFMQWLF

SEQ ID NO: 796940 - protein, 135 aa, Homo sapiens
PSQTPLQPTGTPAGRIPISPELKKEGPRLHHSPYFHHMSRQDLRTTSCSCMVGMLTSTPGSTANQPSTLAGAGTPADTPPFCTSVHSTVTVHMVPPCTPHLQNSRTSSIPLGTFFGEKLLGSVGACPHRHWYLTP

SEQ ID NO: 796941 - protein, 148 aa, Homo sapiens
FKWAGDLGADEESIRNLFDFTPKYRATHEDQKFKKVKECSSELKYSMELDEDGAWYLKPKLWKKLRSDEPLIDPKLLLKKPDEPDVLDDLYGPIAFKDFILSKGYEMPGIIQRLFARRGWTYDSVKTPIQRAMIFYKYKEIVEASEED

SEQ ID NO: 796942 - protein, 269 aa, Homo sapiens
LRRGAQSRFVRVDCPESAAGAGMEPSRHGYHSFLVEPISCHAWNKDRTQIAICPNNHEVHIYEVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHGVCFSASGSRVAWVSHDSTVCLADADKKMAVATLASETLPLRGWVHGVCFSASG

SEQ ID NO: 796943 - protein, 287 aa, Homo sapiens
LRRGAQSRFVRVDCPESAAGAGMEPSRHGYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHGVCFSASGSRVAWVSHDSTVCLADADKKMAVATLASETLPLRGWVHGVCFSASG

SEQ ID NO: 796944 - protein, 111 aa, Homo sapiens
ESRCWTLCPAVDDSSPSGSAVLYPGLAASWSPQQSGTGSQNCLHPIGLSCCLPGLLVTRPTGLDIPPTGQLPVQAQLLPAQKDVSGYPFPPHFPALCSSSWCTPSFSPPPC

SEQ ID NO: 796945 - protein, 107 aa, Homo sapiens
FFGKKAFVTLLSSSCLGPMCTGLDVQQPYLITIMARATYYAGETRRQKKRTTANPFDTCGIRNKCYRNLRDTQGNQKTKWRRENHRLGFVLEKIIQKLIPSVLITIC

SEQ ID NO: 796946 - protein, 102 aa, Homo sapiens
MASTLIDICDLVTSPTFFWHTDCSSLPPVLHLSLAVIPIVLFILLLNKSVSFCKAVFWLVLHNNKPLETWLFTLTSDIILMDFGTHRKTTGSPFSKGLFFQN

SEQ ID NO: 796947 - protein, 119 aa, Homo sapiens
AEDPDTVQESLVPQRAQKSMNKQGFQRTQEQRPHPRRPARKHPSARSQQHGPPGRGGLWVPEYLAVQGAPQYSSEVTSQGPQERHQNSSGTREVQAGSGRFLETAPSWSLGPKVEVPDS

SEQ ID NO: 796948 - protein, 200 aa, Homo sapiens
RRQLQTQAKLVLEENKLLLEQLEIQQRKAKDSHQERLQEVSKLTKQLMLLEAKTHGQEKELAENREQLEILRAKCQELKTHSDGKIAVEVHKSIVNELKSQIKKEEETERAEMEELMEKLTVLQAQKKSLLLEKNSLTEQNKALEAELERAQKINRKSQKKIEVLKKQVEKAMGKRNVLLIQYLANLCWLAEKYTQERDS

SEQ ID NO: 796949 - protein, 153 aa, Homo sapiens
MLLEAKTHGQEKELAENREQLEILRAKCQELKTHSDGKIAVEVHKSIVNELKSQIKKEEETERAEMEELMEKLTVLQAQKKSLLLEKNSLTEQNKALEAELERAQKINRKSQKKIEVLKKQVEKAMGKRNVLLIQYLANLCWLAEKYTQERDS

SEQ ID NO: 796950 - protein, 105 aa, Homo sapiens
MLHPLKLNTYMNMFSGLKAALCLNLLRAGLSILCKSVDSHCAPDFHPSLETSCFQVGTRQGINMITWLRVWTLESDMVWLCPHPNLILNCNSHNSHMWWVDPGGR

SEQ ID NO: 796951 - protein, 108 aa, Homo sapiens
AAATTAISKVRRNCLCGPLIPHSEGGGSWVVQGIRKGKPGTCCALQCSFQRKAARGGRHLHLDVRNALPGWARWLTPVIPALWEAEVDRSRSQEMETILANTLKSRLY

SEQ ID NO: 796952 - protein, 189 aa, Homo sapiens
GTEPSALVDDNGSEEDFSYEDLCQASPRYLQPGGEQLAINELISDGNVVCAEALWDHVTMDDQELGFKAGDVIQVLEASNKDWWWGRSEDKEAWFPASFVRLRVNQEELSENSSSTPSEEQDEEASQSRHRHCENKQQMRTNVIREIMDTERVYIKHLRDICEGYIRQCRKHTGMFTVAQLATIFGNIE

SEQ ID NO: 796953 - protein, 122 aa, Homo sapiens
AYLSCRVFLYSNTHPYGSSGILEMTAGRITGVGARDKAGRGLATQGIEYPIDAGHSSFPTRDAQAFHSFTDSNLALRKERLMCDYSLWKIRRKQIRRNRKNKVSLAKVKLQRGTSLKGKTKA

SEQ ID NO: 796954 - protein, 146 aa, Homo sapiens
QSQKELSNHLCVPLLRNEGAAAEAAPLSCVTSGAGPPSLACCWWCSCVLTLGHFLNNISSITAVAPVSKISLRQVLCLLLSIPLGHPVCPECPCDQSHSCFAVREAKQGAESRQTFQCVLYWDSSLQAQKFSFALPICPGGHPSCT

SEQ ID NO: 796955 - protein, 92 aa, Homo sapiens
KKEKSCHRPSSPVPLVSDFESLGGSESSGQQNQKIPQLPSSPENLVSEIPPPQLGYAVSDENLTLGKKAELQHFPGIWKVLNSEMVLFLQIC

SEQ ID NO: 796956 - protein, 119 aa, Homo sapiens
KKEKSCHRPSSPVPLVSDFESLGGSESSGQQNQKIPQLPSSPENLVSEIPPPQLGYAVSDENLTLGKKAELQVSNNAGEDTTEVNTDPFPETWLAIQPSLSLALPSSETDLTQGANPQL

SEQ ID NO: 796957 - protein, 106 aa, Homo sapiens
RPWPLLTPPPGGPGLDGKLNLATLVLELPYLCIFAPARRCPPVSPHLQHSQAAAGSGDGLCVGSGRYDAPLCCLAAGRPWEFCLISAAQLSFLSIVTPTSLDYWED

SEQ ID NO: 796958 - protein, 113 aa, Homo sapiens
SRSGVPAAFGELGSLVSFWYQSPHCTGQAEVEAEADPSLGPDAYSAAFPTVSAPRLTCPPPRQSSVPGPLLFMRRAGGTWGWGCRTLTGCWAVRKRRNRWLLKLLWSQETQGL

SEQ ID NO: 796959 - protein, 328 aa, Homo sapiens
EQIVARVDVSPFCSGLHTATGRIRSFCCFPQVALECLYHREKRIGIDLVHDNVEKNLIREVDLLKCCQEQMRKLAQRIDIQMRDNRDAQHVLERDLEDKSSAQCIDEKCFNLRNTSDCISFFHGMEKIDGTISVPETWAKFSNDNIKHSQNMRANSIRLREEAEHLFETLSDQMWRQFTDTNLAFNARISEVTDVKNKLQTQLAKTLQEIFQAENTIMLLERSIMAKEGPLKVAQTRLECRTRRPNMELCRDIPQLKLVNEVFTIDDTLQTLKLRLRETQDTLQLLVMTKCRLEHELAIKANTLCIDKEKCMGMRKTFPCTPRLVGHT

SEQ ID NO: 796960 - protein, 330 aa, Homo sapiens
VRPRLGGRVVLTTSPNCPSTGRSAKRGFHAYSQVALECLYHREKRIGIDLVHDNVEKNLIREVDLLKCCQEQMRKLAQRIDIQMRDNRDAQHVLERDLEDKSSAQCIDEKCFNLRNTSDCISFFHGMEKIDGTISVPETWAKFSNDNIKHSQNMRANSIRLREEAEHLFETLSDQMWRQFTDTNLAFNARISEVTDVKNKLQTQLAKTLQEIFQAENTIMLLERSIMAKEGPLKVAQTRLECRTRRPNMELCRDIPQLKLVNEVFTIDDTLQTLKLRLRETQDTLQLLVMTKCRLEHELAIKANTLCIDKEKCMGMRKTFPCTPRLVGHT

SEQ ID NO: 796961 - protein, 139 aa, Homo sapiens
SSAFHHDCKAFLVMWNTLQEIFQAENTIMLLERSIMAKEGPLKVAQTRLECRTRRPNMELCRDIPQLKLVNEVFTIDDTLQTLKLRLRETQDTLQLLVMTKCRLEHELAIKANTLCIDKEKCMGMRKTFPCTPRLVGHT

SEQ ID NO: 796962 - protein, 69 aa, Homo sapiens
VFPPVSGQLKPRDDADENILVCVYTMNCQSSDLMVVKKIGNSQTLLRTTFTSLSASTGSPYSQETHRYT

SEQ ID NO: 796963 - protein, 254 aa, Homo sapiens
MGAAGSDGRCCVRSGRAGTGGAGSKWVVMDLWTGGAGSRRAVLGPDGRWVRWAVLGSVRMGGARSKWAAPDPMGGAGFGPDWRVRVWTGGAGSKWGCSAGSGRAVLGPNGRWVPWAVLGSVRTGGAGSKWAALGPMGGTGSGRAVLGLDGRCSIQMGAAGSGRAVLGSVRTGGAGSKWAVLGSAGDRWAWRHRYGAQGRWSALSEGPCAPRARCSSCPRIAPGLLRVSSRVIPFRWVTSKPTFSSCFLPRRTRC

SEQ ID NO: 796964 - protein, 254 aa, Homo sapiens; identical to SEQ ID NO: 796963

SEQ ID NO: 796965 - protein, 254 aa, Homo sapiens; identical to SEQ ID NO: 796963

SEQ ID NO: 796966 - protein, 107 aa, Homo sapiens
ILCQPRLECSSMISAHCNLCLLDSSDSPASASRIAGITDVHHHAWLIFAFLVETGFHHVGHASLELLTSDDPSASASQTAGITGVSHRARPEFFTSFSTRSVHRNAL

SEQ ID NO: 796967 - protein, 47 aa, Homo sapiens
QFLQNNHEIFELEKGDGPGVVAHACNPNTLGSLGRRIASAQESETSL

SEQ ID NO: 796968 - protein, 65 aa, Homo sapiens
PLCFQLTKLLYLLENGSPALPTCEPCLKGARACQWNHLQELQLLLSLIPLCLFFERDKLFMVLHF

SEQ ID NO: 796969 - protein, 131 aa, Homo sapiens [sequence omitted]

SEQ ID NO: 796970 - protein, 68 aa, Homo sapiens
GWGGRQDGGCGRGSSLLSSPAHPPSPSLPPPSLQERAFAPPPPCSVPARLPESRVSPNPHAQDLRTKV

SEQ ID NO: 796971 - protein, 68 aa, Homo sapiens; identical to SEQ ID NO: 796970

SEQ ID NO: 796972 - protein, 65 aa, Homo sapiens
MERAAVQRSAEGGSPKKPGTGFDHQGSGPRPTVRPTPPAARGLKTKKKRQKKPRIRKEKEQHDRD

SEQ ID NO: 796973 - protein, 117 aa, Homo sapiens
SPWEQVWELRASPGTGTSQDVRKTHASCPRILPCGLRTAGPREGRCSSHVPVAAAWLLQVQLALLAPAARKAEPKGAPWAPGALSHFRSSGMWGFVSGFSLAMFVGSNSYALLPEPV

SEQ ID NO: 796974 - protein, 106 aa, Homo sapiens
PSSGGPACSRQAAGSRQVLSGCGRCGPSHLCVLCSALCLGMARPQQILCSTVTPMEPSKKTVSNFPRCWGPPRSWSRAWPAGSTGWWTVAVSRRASSGSRRTQLAR

SEQ ID NO: 796975 - protein, 2149 aa, Homo sapiens
MAQVPGEVDNMEGLPAPNNNPAARWESPDRGWEREQPAASTAAASLFECSRIKALADEREAVQKKTFTKWVNSHLARVGCHIGDLYVDLRDGFVLTRLLEVLSGEQLPRPTRGRMRIHSLENVDKALQFLKEQRVHLENVGSHDIVDGNHRLTLGLVWTIILRFQIQVIKIETEDNRETRSAKDALLLWCQMKTAGYPEVNIQNFTTSWRDGLAFNALIHRHRPDLVDFSKLTKSNANYNLQRAFRTAEQHLGLARLLDPEDVNMEAPDEKSIITYVVSFYHYFSKMKALAVEGKRIGKVLDQVLEVGKIIERYEELAAELLAWIHRTVGLISNQKFANSLSGVQQQLQAFTAYCTLEKPVKFQEKGNLEVLLFSIQSKLRACNRRLFVPREGCGIWDIDKAWGELEKAEHEREAALRAELIRQEKLELLAQRFDHKVAMRESWLNENQRLVSQDNFGYELPAVEAAMKKHEAIEADIAAYEERVQGVAELAQALAAEGYYDIRRVAAQRDSVLRQWALLTGLVGARRTRLEQNLALQKVFQEMVYMVDWMEEMQAQLLSRECGQHLVEADDLLQKHGLLEGDIAAQSERVEALNAAALRFSQPCDPQVICNRVNHVHGCLAELQEQAARRRAELEASRSLWALLQELEEAESWARDKERLLEAAGGGGAAGAAGAAGTAGGAHDLSSTARLLAQHKILQGELGGRRASLQQALRCGEELVAAGGAVGPGADTVHLVGLAERAASARRRWQRLEEAAARRERRLQEARALHQFGADLDGLLDWLRDAYRLAAAGDFGHDEASSRRLARQHRALTGEVEAHRGPVSGLRRQLATLGGASGAGPLVVALQVRVVEAEQLFAEVTEVAALRRQWLRDALAVYRMFGEVHACELWIGEKEQWLLSMRVPDSLDDVEVVQHRFESLDQEMNSLMGRVLDVNHTVQELVEGGHPSSDEVRSCQDHLNSRWNRIVELVEQRKEEMSAVLLVENHVLEVAEVRAQVREKRRAVESAPRAGGALQWRLSGLEAALQALEPRQAALLEEAALLAERFPAQAARLHQGAEELGAEWGALASAAQACGEAVAAAGRLQRFLHDLDAFLDWLVRAQEAAGGSEGPLPNSLEEADALLARHAALKEEVDQREEDYARIVAASEALLAADGAELGPGLALDEWLPHLELGWHKLLGLWKARRKALVQAHIYQLFLRDLRQALVVLRNQEMALSGAELPGTVESVEEALKQHRDFLTTMELSQQKMQVAVQAAEGLLRQGNIYGEQAQEAVTRLLEKNQENQLRAQQWMQKLHDQLELQHFLRDCHELDGWIHEKMLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDLDDELAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRDVSSVEVLMNYHQGLKTELEARVPELTTCQELGRSLLLNKSAMADEIQAQLDKLGTRKEEVSEKWDRHWEWLQQMLEVHQFAQEAVVADAWLTAQEPLLQSRELGSSVDEVEQLIRRHEAFRKAAAAWEERFSSLRRLTTPRREDHLNPGVQDQPWQHTEKPSLPKPKANKEKTARRDGTCL

SEQ ID NO: 796976 - protein, 2588 aa, Homo sapiens
MAQVPGEVDNMEGLPAPNNNPAARWESPDRGWEREQPAASTAAASLFECSRIKALADEREAVQKKTFTKWVNSHLARVGCHIGDLYVDLRDGFVLTRLLEVLSGEQLPRPTRGRMRIHSLENVDKALQFLKEQRVHLENVGSHDIVDGNHRLTLGLVWTIILRFQIQVIKIETEDNRETRSAKDALLLWCQMKTAGYPEVNIQNFTTSWRDGLAFNALIHRHRPDLVDFSKLTKSNANYNLQRAFRTAEQHLGLARLLDPEDVNMEAPDEKSIITYVVSFYHYFSKMKALAVEGKRIGKVLDQVLEVGKIIERYEELAAELLAWIHRTVGLISNQKFANSLSGVQQQLQAFTAYCTLEKPVKFQEKGNLEVLLFSIQSKLRACNRRLFVPREGCGIWDIDKAWGELEKAEHEREAALRAELIRQEKLELLAQRFDHKVAMRESWLNENQRLVSQDNFGYELPAVEAAMKKHEAIEADIAAYEERVQGVAELAQALAAEGYYDIRRVAAQRDSVLRQWALLTGLVGARRTRLEQNLALQKVFQEMVYMVDWMEEMQAQLLSRECGQHLVEADDLLQKHGLLEGDIAAQSERVEALNAAALRFSQPCDPQVICNRVNHVHGCLAELQEQAARRRAELEASRSLWALLQELEEAESWARDKERLLEAAGGGGAAGAAGAAGTAGGAHDLSSTARLLAQHKILQGELGGRRASLQQALRCGEELVAAGGAVGPGADTVHLVGLAERAASARRRWQRLEEAAARRERRLQEARALHQFGADLDGLLDWLRDAYRLAAAGDFGHDEASSRRLARQHRALTGEVEAHRGPVSGLRRQLATLGGASGAGPLVVALQVRVVEAEQLFAEVTEVAALRRQWLRDALAVYRMFGEVHACELWIGEKEQWLLSMRVPDSLDDVEVVQHRFESLDQEMNSLMGRVLDVNHTVQELVEGGHPSSDEVRSCQDHLNSRWNRIVELVEQRKEEMSAVLLVENHVLEVAEVRAQVREKRRAVESAPRAGGALQWRLSGLEAALQALEPRQAALLEEAALLAERFPAQAARLHQGAEELGAEWGALASAAQACGEAVAAAGRLQRFLHDLDAFLDWLVRAQEAAGGSEGPLPNSLEEADALLARHAALKEEVDQREEDYARIVAASEALLAADGAELGPGLALDEWLPHLELGWHKLLGLWKARRKALVQAHIYQLFLRDLRQALVVLRNQEMALSGAELPGTVESVEEALKQHRDFLTTMELSQQKMQVAVQAAEGLLRQGNIYGEQAQEAVTRLLEKMPHYPSCSSAPSLGTPIPPQIQQLEARHRNQENQLRAQQWMQKLHDQLELQHFLRDCHELDGWIHEKMLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDLDDELAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRDVSSVEVLMNYHQGLKTELEARVPELTTCQELGRSLLLNKSAMADEIQAQLDKLGTRKEEVSEKWDRHWEWLQQMLEVHQFAQEAVVADAWLTAQEPLLQSRELGSSVDEVEQLIRRHEAFRKAAAAWEERFSSLRRLTTIEKIKAEQSKQPPTPLLGRKFFGDPTELAAKAAPLLRPGGYERGLEPLARRASDTLSAEVRTRVGYVRQELKPERLQPRIDRLPEIPGRVEPAALPAAPEDAAETPATPAAAEQVRPRPERQESADRAEELPRRRRPERQESVDQSEEAARRRRPERQESAEHEAAHSLTLGRYEQMERRRERRERRLERQESSEQEMPIRGDLVKGKATLADIVEQLQEKEAGPGLPAGPSLPQPRELPPGRLPNGLELPERTPRPDRPRARDRPKPRRRPRPREGGEGGGSRRSRSAPAQGGSAPAPPPPPTHTVQHEGFLLRKRELDANRKSSNRSWVSLYCVLSKGELGFYKDSKGPASGSTHGGEPLLSLHKATSEVASDYKKKKHVFKLQTQDGSEFLLQAKDEEEMNGWLEAVASSVAEHAEIARWGQTLPTTSSTDEGNPKREGGDRRASGRRK

SEQ ID NO: 796977 - protein, 51 aa, Homo sapiens
MSPFSEQISRRQSQVDRLYVALKELGEERRVALEQQYWLYQLSRQVSELEH

SEQ ID NO: 796978 - protein, 2559 aa, Homo sapiens
MAQVPGEVDNMEGLPAPNNNPAARWESPDRGWEREQPAASTAAASLFECSRIKALADEREAVQKKTFTKWVNSHLARVGCHIGDLYVDLRDGFVLTRLLEVLSGEQLPRPTRGRMRIHSLENVDKALQFLKEQRVHLENVGSHDIVDGNHRLTLGLVWTIILRFQIQVIKIETEDNRETRSAKDALLLWCQMKTAGYPEVNIQNFTTSWRDGLAFNALIHRHRPDLVDFSKLTKSNANYNLQRAFRTAEQHLGLARLLDPEDVNMEAPDEKSIITYVVSFYHYFSKMKALAVEGKRIGKVLDQVLEVGKIIERYEELAAELLAWIHRTVGLISNQKFANSLSGVQQQLQAFTAYCTLEKPVKFQEKGNLEVLLFSIQSKLRACNRRLFVPREGCGIWDIDKAWGELEKAEHEREAALRAELIRQEKLELLAQRFDHKVAMRESWLNENQRLVSQDNFGYELPAVEAAMKKHEAIEADIAAYEERVQGVAELAQALAAEGYYDIRRVAAQRDSVLRQWALLTGLVGARRTRLEQNLALQKVFQEMVYMVDWMEEMQAQLLSRECGQHLVEADDLLQKHGLLEGDIAAQSERVEALNAAALRFSQPCDPQVICNRVNHVHGCLAELQEQAARRRAELEASRSLWALLQELEEAESWARDKERLLEAAGGGGAAGAAGAAGTAGGAHDLSSTARLLAQHKILQGELGGRRASLQQALRCGEELVAAGGAVGPGADTVHLVGLAERAASARRRWQRLEEAAARRERRLQEARALHQFGADLDGLLDWLRDAYRLAAAGDFGHDEASSRRLARQHRALTGEVEAHRGPVSGLRRQLATLGGASGAGPLVVALQVRVVEAEQLFAEVTEVAALRRQWLRDALAVYRMFGEVHACELWIGEKEQWLLSMRVPDSLDDVEVVQHRFESLDQEMNSLMGRVLDVNHTVQELVEGGHPSSDEVRSCQDHLNSRWNRIVELVEQRKEEMSAVLLVENHVLEVAEVRAQVREKRRAVESAPRAGGALQWRLSGLEAALQALEPRQAALLEEAALLAERFPAQAARLHQGAEELGAEWGALASAAQACGEAVAAAGRLQRFLHDLDAFLDWLVRAQEAAGGSEGPLPNSLEEADALLARHAALKEEVDQREEDYARIVAASEALLAADGAELGPGLALDEWLPHLELGWHKLLGLWKARRKALVQAHIYQLFLRDLRQALVVLRNQEMALSGAELPGTVESVEEALKQHRDFLTTMELSQQKMQVAVQAAEGLLRQGNIYGEQAQEAVTRLLEKNQENQLRAQQWMQKLHDQLELQHFLRDCHELDGWIHEKMLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDLDDELAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRDVSSVEVLMNYHQGLKTELEARVPELTTCQELGRSLLLNKSAMADEIQAQLDKLGTRKEEVSEKWDRHWEWLQQMLEVHQFAQEAVVADAWLTAQEPLLQSRELGSSVDEVEQLIRRHEAFRKAAAAWEERFSSLRRLTTIEKIKAEQSKQPPTPLLGRKFFGDPTELAAKAAPLLRPGGYERGLEPLARRASDTLSAEVRTRVGYVRQELKPERLQPRIDRLPEIPGRVEPAALPAAPEDAAETPATPAAAEQVRPRPERQESADRAEELPRRRRPERQESVDQSEEAARRRRPERQESAEHEAAHSLTLGRYEQMERRRERRERRLERQESSEQEMPIRGDLVKGKATLADIVEQLQEKEAGPGLPAGPSLPQPRELPPGRLPNGLELPERTPRPDRPRARDRPKPRRRPRPREGGEGGGSRRSRSAPAQGGSAPAPPPPPTHTVQHEGFLLRKRELDANRKSSNRSWVSLYCVLSKGELGFYKDSKGPASGSTHGGEPLLSLHKATSEVASDYKKKKHVFKLQTQDGSEFLLQAKDEEEMNGWLEAVASSVAEHAEIARWGQTLPTTSSTDEGNPKREGGDRRASGRRK

SEQ ID NO: 796979 - protein, 723 aa, Homo sapiens
RPPEPQPSPPLPLPSQLRGEHPPARCRDAPPTPLPLQLDGWIHEKMLMARDGTREDNHKLHKRWLRHQAFMAELAQNKEWLEKIEREGQQLMQEKPELAASVRKKLGEIRQCWAELESTTQAKARQLFEASKADQLVQSFAELDKKLLHMESQLQDVDPGGDLATVNSQLKKLQSMESQVEEWYREVGELQAQTAALPLEPASKELVGERQNAVGERLVRLLEPLQERRRLLLASKELHQVAHDLDDELAWVQERLPLAMQTERGNGLQAVQQHIKKNQGLRREIQAHGPRLEEVLERAGALASLRSPEAEAVRRGLEQLQSAWAGLREAAERRQQVLDAAFQVEQYYFDVAEVEAWLGEQELLMMSEDKGKDEQSTLQLLKKHLQLEQGVENYEESIAQLSRQCRALLEMGHPDSEQISRRQSQVDRLYVALKELGEERRVALEQQYWLYQLSRQVSELEHWIAEKEVVAGSPELGQDFEHVSVLQEKFSEFASETGMAGRERLAAVNQMVDELIECGHTAAATMAEWKDGLNEAWAELLELMGTRAQLLAASRELHKFFSDARELQGQIEEKRRRLPRLTTPPEPRPSASSMQRTLRAFEHDLQLLVSQVRQLQEGAAQLRTVYAGEHAEAIASREQEVLQGWKELLSACEDARLHVSSTADALRFHSQVRDLLSWMDGIASQIGAADKPRCPSSLLGLPASPWWPTPATPSPLTAPFSME

SEQ ID NO: 796980 - protein, 164 aa, Homo sapiens
MEVTCLLLLALIPFHCRGQGVYAPAQAQIVHAGQACVVKEDNISERVYTIREGDTLMLQCLVTGHPRPQVRWTKTAGSASDKFQETSVFNETLRIERIARTQGGRYYCKAENGVGVPAIKSIRVDVQCELRPPLSPGPDSPARARGRPRDEVRWGSGHGVERRS

SEQ ID NO: 796981 - protein, 92 aa, Homo sapiens
MGERGCRCRALSAEAPTPCESDSLTLPRLAAQVRWTKTAGSASDKFQETSVFNETLRIERIARTQGGRYYCKAENGVGVPAIKSIRVDVQCE

SEQ ID NO: 796982 - protein, 106 aa, Homo sapiens
GAPLAVRAVTPVSIAHGTAVMRLSVPPQQASGQTPPRVIGVVIQGPEVKSKAVAKKQERDVETLQFVEEKLADGNKTVTHVVVVSVPSATALPVTMKTEGLVTCEK

SEQ ID NO: 796983 - protein, 160 aa, Homo sapiens
TKGRAKIRKMKVTTKINHHDKINGKRKTAKKQKMFQRAQELRRRAEDYHKCKIPPSARKALCNWVRMAAAEHRHSSGLPYWPYLTAEILKNRMGHQPPPPTQQHSIIDNSLSLKTPPECLLTPLPPSADDYLKTPPECLLTPLPPSAPPSSDDNLKTPPE

SEQ ID NO: 796984 - protein, 160 aa, Homo sapiens; identical to SEQ ID NO: 796983

SEQ ID NO: 796985 - protein, 160 aa, Homo sapiens; identical to SEQ ID NO: 796983

SEQ ID NO: 796986 - protein, 160 aa, Homo sapiens; identical to SEQ ID NO: 796983

SEQ ID NO: 796987 - protein, 160 aa, Homo sapiens; identical to SEQ ID NO: 796983

SEQ ID NO: 796988 - protein, 89 aa, Homo sapiens
AQMGAVPEMLILSVQRERMRAGLEGRRHKTAKEEEDYRHEATRSYSAALPSSPGDSPVTTQTLRECGLANRRGTTQGQNTEAYSPGMSI

SEQ ID NO: 796989 - protein, 101 aa, Homo sapiens
RRSRHANTDSSWPTGFSQPSESAAPPASLFQPGRRDALRACALSRPPSPLSPAGALVRVGRGEQVPLLQRPRPRRLRNGHLRPLSPPESLSLSHLQAKQHT

SEQ ID NO: 796990 - protein, 141 aa, Homo sapiens
RAKEISTIGMLMLVHKKSFTKYLVTSIMSSDRRQHSHWHRLWGQLCFWGQHCFWGMALFLGRPPSAQAATNRSDTQSQEVVMNSLLWLKLFAAWCFLKDFSLNNRAKTQTAFIQNKRKSYPELNLHMRIKHALPSPRKSNT

SEQ ID NO: 796991 - protein, 71 aa, Homo sapiens
LAAQHGGPAPPQPPDAEPEEPRFQLEELALPSGLWRPKLAGQASSLHHPATGDQGAGFPRTRENCSHLCTC

SEQ ID NO: 796992 - protein, 102 aa, Homo sapiens
MPPKNKEKGKKSGAHKKKKNWGESWWVEVPPASPCSAMKTTQSSSRENSAFCRTGWSSLDLPLSCPHSQIQGAEEVGKWSPTLSFKPHLALCLPNIFVMCIL

SEQ ID NO: 796993 - protein, 85 aa, Homo sapiens
PGTAGLSKAMTCTLPSATTEPGGLAASCVTNLEECGTGHFCSQRVYCPLLCRPKVTEADLPRSEIYFAQVEDVRGKKKYKFQCYL

SEQ ID NO: 796994 - protein, 112 aa, Homo sapiens
DSSSNGFEWNHRIKLIEIIIKWNRMVSLNGIEWNHHQMEMNGIVIEWNRMESSNGLEWNNHGTESNGIIIGWKRMESSSNGNERSHHLMELHGIIIKWNRMESTSNGIKWNH

SEQ ID NO: 796995 - protein, 74 aa, Homo sapiens
RPGALQDPPSPPLLGSLDQHPFLGGWSLVLISSYISHSLQGKISSPYPSCFCRRAPGCVGRTSVSRVDLPSTEE

SEQ ID NO: 796996 - protein, 111 aa, Homo sapiens
MAPPQARACLGIRAALAVACSLTTRREPCPAEKKSPSVREEAPTKLRTRAETRRRWGRCLGAVPLPPLTLQMTELRPRAAKWLAQGHPAGTGRKSLPQGLCGSSVTIKDQR

SEQ ID NO: 796997 - protein, 124 aa, Homo sapiens [sequence omitted]

SEQ ID NO: 796998 - protein, 474 aa, Homo sapiens
MKFIQLERLYHEQLLANLSAIQEQWETKWKTVQPHTVTALRNSEKGFNGEDFERLTKICATHQDPLLSKHKIAAVEKSQERKCSTQLLVSEDPKEGGATTKESESKTCLGTESSKESQHTVEPLGSSPCCHQMDVQTDSPSLSVTAGKDHMEELLCSAEATLALHTQSSETAGSPSGPDSSEDACEDDSRLQLAQTEACQDVARIEGIAEDPKVFLSSKSKTEPLISPGCDRIPPALISEGKYSQAQRKELRLPLRDASEALPTDQLENNELNELQQPDLTDSDGKSPQAQADSDGSENVLCGNNQISDLGILLPEVCMAPEEKGDKDDQLNKETEDYLNSLLEGCLKDTEDSLSYEDNQDDDSDLLQDLSPEEASYSLQENLPSDESCLSLDDLAKRIEIAEVVPTEGLVSILKKRNDTVGDHPAQMQHKPSKRRVRFQEIDDSLDQESLGFGELRTLNECSYVHKSYLNKVV

SEQ ID NO: 796999 - protein, 407 aa, Homo sapiens [sequence omitted]

SEQ ID NO: 797000 - protein, 119 aa, Homo sapiens
LLCNGEKRGPLPAAPALLPRPARAREDHEGTGVGAGSVWGQRVGLWGGYRKETGRVQLFERFSPSTSVCEKARSWVEGSCQDCLLDWVIVHFFILHLKRPRDLSKLIYLPMTVRKTKKL

SEQ ID NO: 797001 - protein, 89 aa, Homo sapiens
LLCNGEKRGPLPAAPALLPRPARAREDHEGTGVGAGSVWGQRVGLWGGYRKETGRVQLFERFSPSTSVCEKARSWVEGSCQDCLLDWVR

SEQ ID NO: 797002 - protein, 82 aa, Homo sapiens
SPGSRRSTSRLDSLSRTLSPSLSRASGLGRESPDSRLSLGRSCLEEWDDGASMALSEACSQYSHPSLARSLSVPPRPRSSAS

SEQ ID NO: 797003 - protein, 120 aa, Homo sapiens
FFETESCSVAQAGAQWRDLSSLQHLLGSSDSPASASQVAGITGMRHHARLIFVFLVETGFRHVGQAGLKLLTLSDPSASSSQSARITGMSHHAQPLLRALCAALHLILIYIIYPLEVSSI

SEQ ID NO: 797004 - protein, 132 aa, Homo sapiens
MAFDSTWKVDRSENYDKFMEKMGVNIVKRKLAAHDNLKLTITQEGNKFTVKESSAFRNIEVVFELGVTFNYNLADGTELRGTWSLEGNKLIGKFKRTDNGNELNTVREIIGDELVQTYVYEGVEAKRIFKKD

SEQ ID NO: 797005 - protein, 140 aa, Homo sapiens
SSEGSQIPQPPGARAGQPPAGHTFSQQPRRGVCCPPHRAGHDLLEVLAQLAGGEVGGQPGAAGLDHRHLPDPWAWLRPEHYPNSPTPFQPSSPNPKPAGPQVEAGQRPGGQPLPSPVTPLPSGHGRSHRQPSPRDVCVCV

SEQ ID NO: 797006 - protein, 149 aa, Homo sapiens
MALRWGIVSVGLISSDFTAVLQTLPRSEHQVVAVAARDLSRAKEFAQKHDIPKAYGSYEELAKDPSVGHLDPLLSCLRGSEVCFGPGNSRRPPGGSGRIWEESHPRSPGRRPGPGWGGPAGHRHLLCPVHLHGLWRAEAREDFCRGKAS

SEQ ID NO: 797007 - protein, 334 aa, Homo sapiens
MALRWGIVSVGLISSDFTAVLQTLPRSEHQVVAVAARDLSRAKEFAQKHDIPKAYGSYEELAKDPSVEVAYIGTQHPQHKAAVMLCLAAGKAVLCEKPTGVNAAEVREMVAEARSRALFLMEAIWTRFFPASEALRSVLAQGTLGDLRVARAEFGKNLIHVPRAVDRAQAGGALLDIGIYCVQFTSMVFGGQKPEKISVVGRRHETGVDDTVTVLLQYPGEVHGSFTCSITVQLSNTASVSGTKGMVQLLNPCWCPTELVVKGEHKEFPLPPVPKDCNFDNGAGMSYEAKHVWECLRKGMKESPVIPLSESELLADILEEVRKAIGVTFPQDKR

SEQ ID NO: 797008 - protein, 228 aa, Homo sapiens
MALRWGIVSVGLISSDFTAVLQTLPRSEHQVVAVAARDLSRAKEFAQKHDIPKAYGSYEELAKDPSVEVAYIGTQHPQHKAAVMLCLAAGKAVLCEKPTGVNAAEVREMVAEARSRALFLMEAIWTRFFPASEALRSVLAQGTLGDLRVARAEFGKNLIHVPRAVDRAQAGGALLDIGIYCVQFTSMVFGGQKPEKISVVGRRHETGTIYPGIFHGDGNDSVSLGALN

SEQ ID NO: 797009 - protein, 36 aa, Homo sapiens
CPSQKILWPPPYGPVLLPYATSSVTYPKGPGLVFVP

SEQ ID NO: 797010 - protein, 100 aa, Homo sapiens
ARGSWGGTPPAATTRFADDIPLAVMELVSAWRRLDPGRLQGPESHPSHSLEAGSAVGKLPAKAQERVILYPVQLHLGGFSFLTTSSSTGFVTVLTPTQTS

SEQ ID NO: 797011 - protein, 83 aa, Homo sapiens
LVVPMVPTVKEFTRAQKKGTIPAVVIRQRKSYRRKDGVFLYEDNAGVIVNNKGEMKGSAITGPVAKECADLWPRIASNAGSIA

SEQ ID NO: 797012 - protein, 83 aa, Homo sapiens
VGCFKGGTMKKLLWKPLWGPGLVTKLALLIVIIDGGIFSFSQTAGAVETCPALCDQFISNKTAKIRASVNLLVKLDTSSFCFM

SEQ ID NO: 797013 - protein, 101 aa, Homo sapiens
RCPCQKDPWRTEHRMTRAGARGFLGAVPSFQATAVLLDGVRALGCRSDFQVLLSTSLLINQLQESACQVVSHKQGTLTVIWLKHLSSVTDASPASSLIKGQ

SEQ ID NO: 797014 - protein, 204 aa, Homo sapiens
RDRSSTGANKEQTNPRIPSKEYTFVMGPETWVGGPGSVVIAAKMGKRPLNTSLVPNSARAHQCKVSMTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSV

SEQ ID NO: 797015 - protein, 152 aa, Homo sapiens
RDRSSTGANKEQTNPRIPSKEYTFVMGPETWVGGPGSVVIAAKMGKRPLNTSLVPNSARAHQCKVSMTALFLMSMLFGLACGQAMSFCIPTEYTMHIERRECAYCLTINTTICAGYCMTRDINGKLFLPKYALSQDVCTYSMLLPIFPILLL

SEQ ID NO: 797016 - protein, 117 aa, Homo sapiens
KRQNCGDSKNHQWLRGWRVGEERAEPRVFRSMKPFCILCKWRTRVLHLSESTEWLTPRVGSNGCRGLGVMAHPCGLAALINVCSGGRGCAGVMVREAVHAWGQGVCGTLCTFCSILP

SEQ ID NO: 797017 - protein, 115 aa, Homo sapiens
MSKGHRIEEVPELPLVVEDKVEGYKKTKEAVLLLKKLKAWNDIKKDYASQRMRAGKGKMRNRHCIQCTGPYIIYNEDNGIIKAFRNIPGITLLNVSKLNILKLAPGWACWFLHLD

SEQ ID NO: 797018 - protein, 1371 aa, Homo sapiens [sequence omitted]

SEQ ID NO: 797019 - protein, 1275 aa, Homo sapiens
MSLDFGSVALPVQNEDEEYDEEDYEREKELQQLLTDLPHDMLDDDLSSPELQYSDCSEDGTDGQPHHPEQLEMSWNEQMLPKSQSVNGPSCQGLEPYNKVTYKPYQSSAQNNGSPAQEITGSDTFEGLQQQFLGANENSAENMQIIQLQVLNKAKERQLENLIEKLNESERQIRYLNHQLVIIKDEKDGLTLSLRESQKLFQNGKEREIQLEAQIKALETQIQALKVNEEQMIKKSRTTEMALESLKQQLVDLHHSESLQRAREQHESIVMGLTKKYEEQVLSLQKNLDATVTALKEQEDICSRLKDHVKQLERNQEAIKLEKTEIINKLTRSLEESQKQCAHLLQSGSVQEVAQLQFQLQQAQKAHAMSANMNKALQEELTELKDEISLYESAAKLGIHPSDSEGELNIELTESYVDLGIKKVNWKKSKVTSIVQEEDPNEELSKDEFILKLKAEVQRLLGSNSMKRHLVSQLQNDLKDCHKKIEDLHQVKKDEKSIEVETKTDTSEKPKNQLWPESSTSDVVRDDILLLKNEIQVLQQQNQELKETEGKLRNTNQDLCNQMRQMVQDFDHDKQEAVDRCERTYQQHHEAMKTQIRESLLAKHALEKQQLFEAYERTHLQLRSELDKLNKEVTAVQECYLEVCREKDNLELTLRKTTEKEQQTQEKIKEKLIQQLEKEWQSKLDQTIKAMKKKTLDCGSQTDQVTTSDVISKKEMAIMIEEQKCTIQQNLEQEKDIAIKGAMKKLEIELELKHCENITKQVEIAVQNAHQRWLGELPELAEYQALVKAEQKKWEEQHEVSVNKRISFAVSEAKEKWKSELENMRKNILPGKELEEKIHSLQKELELKNEEVPVVIRAELAKARSEWNKEKQEEIHRIQEQNEQDYRQFLDDHRNKINEVLAAAKEDFMKQKTELLLQKETELQTCLDQSRREWTMQEAKRIQLEIYQYEEDILTVLGVLLSDTQKEHISDSEDKQLLEIMSTCSSKWMSVQYFEKLKGCIQKAFQDTLPLLVENADPEWKKRNMAELSKDSASQGTGQGDPGPAAGHHAQPLALQATEAEADKKKVLEIKDLCCGHCFQELEKAKQECQDLKGKLEKCCRHLQHLERKHKAVVEKIGEENNKVVEELIEENNDMKNKLEELQTLCKTPPRSLSAGAIENACLPCSGGALEELRGQYIKAVKKIKCDMLRYIQESKERAAEMVKAEVLRERQETARKMRKYYLICLQQILQDDGKEGAEKKIMNAASKLATMAKLLETPISSKSQSKTTQSGMSK

SEQ ID NO: 797020 - protein, 1368 aa, Homo sapiens
MSLDFGSVALPVQNEDEEYDEEDYEREKELQQLLTDLPHDMLDDDLSSPELQYSDCSEDGTDGQPHHPEQLEMSWNEQMLPKSQSVNGYNEIQSLYAGEKCGNVWEENRSKTEDRHPVYHPEEGGDEGGSGYSPPSKCEQTDLYHLPENFRPYTNGQKQEFNNQATNVIKFSDPQWNHFQGPSCQGLEPYNKVTYKPYQSSAQNNGSPAQEITGSDTFEGLQQQFLGANENSAENMQIIQLQVLNKAKERQLENLIEKLNESERQIRYLNHQLVIIKDEKDGLTLSLRESQKLFQNGKEREIQLEAQIKALETQIQALKVNEEQMIKKSRTTEMALESLKQQLVDLHHSESLQRAREQHESIVMGLTKKYEEQVLSLQKNLDATVTALKEQEDICSRLKDHVKQLERNQEAIKLEKTEIINKLTRSLEESQKQCAHLLQSGSVQEVAQLQFQLQQAQKAHAMSANMNKALQEELTELKDEISLYESAAKLGIHPSDSEGELNIELTESYVDLGIKKVNWKKSKVTSIVQEEDPNEELSKDEFILKLKAEVQRLLGSNSMKRHLVSQLQNDLKDCHKKIEDLHQVKKDEKSIEVETKTDTSEKPKNQLWPESSTSDVVRDDILLLKNEIQVLQQQNQELKETEGKLRNTNQDLCNQMRQMVQDFDHDKQEAVDRCERTYQQHHEAMKTQIRESLLAKHALEKQQLFEAYERTHLQLRSELDKLNKEVTAVQECYLEVCREKDNLELTLRKTTEKEQQTQEKIKEKLIQQLEKEWQSKLDQTIKAMKKKTLDCGSQTDQVTTSDVISKKEMAIMIEEQKCTIQQNLEQEKDIAIKGAMKKLEIELELKHCENITKQVEIAVQNAHQRWLGELPELAEYQALVKAEQKKWEEQHEVSVNKRISFAVSEAKEKWKSELENMRKNILPGKELEEKIHSLQKELELKNEEVPVVIRAELAKARSEWNKEKQEEIHRIQEQNEQDYRQFLDDHRNKINEVLAAAKEDFMKQKTELLLQKETELQTCLDQSRREWTMQEAKRIQLEIYQYEEDILTVLGVLLSDTQKEHISDSEDKQLLEIMSTCSSKWMSVQYFEKLKGCIQKAFQDTLPLLVENADPEWKKRNMAELSKDSASQGTGQGDPGPAAGHHAQPLALQATEAEADKKKVLEIKDLCCGHCFQELEKAKQECQDLKGKLEKCCRHLQHLERKHKAVVEKIGEENNKVVEELIEENNDMKNKLEELQTLCKTPPRSLSAGAIENACLPCSGGALEELRGQYIKAVKKIKCDMLRYIQESKERAAEMVKAEVLRERQETARKMRKYYLICLQQILQDDGKEGAEKKIMNAASKLATMAKLLETPISSKSQSKTTQSGMSK

SEQ ID NO: 797021 - protein, 72 aa, Homo sapiens
PCRSLYTNLPASRQLSPLEPKLYMSACTGMGSSPPKSKDMDNEGRDKAEIEDEDEDEFKDEDQDEDKDEDGV

SEQ ID NO: 797022 - protein, 83 aa, Homo sapiens
MGKFMKPGKVVLVLAGRYSGCKAVIVKNIDDSTSDCPYSHALVSGIDHYPCKVTAAMGKKKITKGSKIKSFAKVCNYNHLMPK

SEQ ID NO: 797023 - protein, 1074 aa, Homo sapiens
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRWLIVKDSFLLYMKPDSGAIAFVLLVDKEFKIKVGKKETETKYGIRIDNLSRTLILKCNSYRHARWWGGAIEEFIQKHGTNFLKDHRFGSYAAIQENALAKWYVNAKGYFEDVANAMEEANEEIFITDWWLSPEIFLKRPVVEGNRWRLDCILKRKAQQGVRIFIMLYKEVELALGINSEYTKRTLMRLHPNIKVMRHPDHVSSTVYLWAHHEKLVIIDQSVAFVGGIDLAYGRWDDNEHRLTDVGSVKRVTSGPSLGSLPPAAMESMESLRLKDKNEPVQNLPIQKSIDDVDSKLKGIGKPRKFSKFSLYKQLHRHHLHDADSISSIDSTSSYFNHYRSHHNLIHGLKPHFKLFHPSSESEQGLTRPHADTGSIRSLQTGVGELHGETRFWHGKDYCNFVFKDWVQLDKPFADFIDRYSTPRMPWHDIASAVHGKAARDVARHFIQRWNFTKIMKSKYRSLSYPFLLPKSQTTAHELRYQVPGSVHANVQLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRVVLGYLDDPSEDIQDPVSDKFFKEVWVSTAARNATIYDKVFRCLPNDEVHNLIQLRDFINKPVLAKEDPIRAEEELKKIRGFLVQFPFYFLSEESLLPSVGTKEAIVPMEVWT

SEQ ID NO: 797024 - protein, 279 aa, Homo sapiens
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRLQNPPVCVHSSLGSVNSSQEQPSAKN

SEQ ID NO: 797025 - protein, 347 aa, Homo sapiens
PLCSAMIVRPPQPCGTLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRVVLGYLDDPSEDIQDPVSDKFFKEVWVSTAARNATIYDKVFRCLPNDEVHNLIQLRDFINKPVLAKEDPIRAEEELKKIRGFLVQFPFYFLSEESLLPSVGTKEAIVPMEVWT

SEQ ID NO: 797026 - protein, 313 aa, Homo sapiens
SSVPVKAHPIENSRHYIYENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRVVLGYLDDPSEDIQDPVSDKFFKEVWVSTAARNATIYDKVFRCLPNDEVHNLIQLRDFINKPVLAKEDPIRAEEELKKIRGFLVQFPFYFLSEESLLPSVGTKEAIVPMEVWT

SEQ ID NO: 797027 - protein, 971 aa, Homo sapiens
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRWLIVKDSFLLYMKPDSGAIAFVLLVDKEFKIKVGKKETETKYGIRIDNLSRTLILKCNSYRHARWWGGAIEEFIQKHGTNFLKDHRFGSYAAIQENALAKWYVNAKGYFEDVANAMEEANEEIFITDWWLSPEIFLKRPVVEGNRWRLDCILKRKAQQGVRIFIMLYKEVELALGINSEYTKRTLMRLHPNIKVMRHPDHVSSTVYLWAHHEKLVIIDQSVAFVGGIDLAYGRWDDNEHRLTDVGSVKRVTSGPSLGSLPPAAMESMESLRLKDKNEPVQNLPIQKSIDDVDSKLKGIGKPRKFSKFSLYKQLHRHHLHDADSISSIDSTSSYFNHYRSHHNLIHGLKPHFKLFHPSSESEQGLTRPHADTGSIRSLQTGVGELHGETRFWHGKDYCNFVFKDWVQLDKPFADFIDRYSTPRMPWHDIASAVHGKAARDVARHFIQRWNFTKIMKSKYRSLSYPFLLPKSQTTAHELRYQVPGSVHANVQLLRSAADWSAGIKYHEESIHAAYVHVIENSRHYIYIENQFFISCADDKVVFNKIGDAIAQRILKAHRENQKYRVYVVIPLLPGFEGDISTGGGNALQAIMHFNYRTMCRGENSILGQLKAELGNQWINYISFCGLRTHAELEGNLVTELIYVHSKLLIADDNTVIIGSANINDRSMLGKRDSEMAVIVQDTETVPSVMDGKEYQAGRFARGLRLQCFRSKMTPGVEDP

SEQ ID NO: 797028 - protein, 1074 aa, Homo sapiens; identical to SEQ ID NO: 797023

SEQ ID NO: 797029 - protein, 399 aa, Homo sapiens [sequence omitted]

SEQ ID NO: 797030 - protein, 1074 aa, Homo sapiens; identical to SEQ ID NO: 797023

SEQ ID NO: 797031 - protein, 135 aa, Homo sapiens
ASSCPPPSCRCMGRLVPAAPASLVGSTLALPLLRPEVDFVVFRGCLAFRPFWGSGIMTFDLKDSRDFGRDPWAPGSSSTGLSPGSSWLCPWGATGRNSPGHPWDQRGLTSDVRYPAFSQGPPFYFSEALPGRSQK

SEQ ID NO: 797032 - protein, 139 aa, Homo sapiens
MSSHLVQSCHIKMSYQNIQEYFGNMDSQVVFVGAKRTAGHVQSNVWKESAISEEPKSGVIIIMEDESVFQCLPHSFPKVNHPGLGCSNIWNSLSTTSTSVTQNVTHLLPMFSDHIESERGNKTYKLLSPRLTNSVVLKG

SEQ ID NO: 797033 - protein, 127 aa, Homo sapiens [sequence omitted]

SEQ ID NO: 797034 - protein, 127 aa, Homo sapiens [sequence omitted]

SEQ ID NO: 797035 - protein, 76 aa, Homo sapiens
LSSPPIFHHNYYNATHHPYVAILYKAVISKCHIKISKSTLEIWIPKLFLWVPKGLLVMFKAMYGKSPPSQRNQRVE

SEQ ID NO: 797036 - protein, 127 aa, Homo sapiens [sequence omitted]

SEQ ID NO: 797037 - protein, 155 aa, Homo sapiens
FVKLQVLLFYYNKRATVISHLVQSCHIKMSYQNIQEYFGNMDSQVVFVGAKRTAGHVQSNVWKESAISEEPKSGVIIIMEDESVFQCLPHSFPKVNHPGLGCSNIWNSLSTTSTSVTQNVTHLLPMFSDHIESERGNKTYKLLSPRLTNSVVLKG

SEQ ID NO: 797038 - protein, 127 aa, Homo sapiens [sequence omitted]

SEQ ID NO: 797039 - protein, 218 aa, Homo sapiens
MSFVGENSGVKMGSEDWEKDEPQCCLEDPAGSPLEPGPSLPTMNFVHTSPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 797040 - protein, 218 aa, Homo sapiens; identical to SEQ ID NO: 797039

SEQ ID NO: 797041 - protein, 192 aa, Homo sapiens
MSGCDRRETETKGKNSFKKRLRGPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 797042 - protein, 192 aa, Homo sapiens; identical to SEQ ID NO: 797041

SEQ ID NO: 797043 - protein, 178 aa, Homo sapiens
MSFVGENSGVKMGSEDWEKDEPQCCLEDPAGSPLEPGPSLPTMNFVHTKIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 797044 - protein, 114 aa, Homo sapiens
TASSGDRTTPPRLHPGLPPPWTPVDDLPLSPPRPCPSSSLPGLGAPLAGPPSATAPDRPRPLPERRHPLPLGLPSPVLAGPLPPGKPGRRVPPPSSGGLYRPRLRPGPAEELPT

SEQ ID NO: 797045 - protein, 83 aa, Homo sapiens
TASSGDRTTPPRLHPGLPPPWTPVDDLPLSPPRPCPSSSLPGLGAPLAGPLPPGKPGRRVPPPSSGGLYRPRLRPGPAEELPT

SEQ ID NO: 797046 - protein, 34 aa, Homo sapiens
MWSTSVNIKVSGFMEAGEATYNYTMCPYFTWASR

SEQ ID NO: 797047 - protein, 111 aa, Homo sapiens
MNLLQRGRISRKNSTFQNQGFQARAAPHTRCRASSHCGFKSTEIHKTMYNCKLNTTAIKAIIPNTGNTSRTPFFYLPRLKSRIFRTIIRAQADFNIKAWSNTIYYFSITSL

SEQ ID NO: 797048 - protein, 70 aa, Homo sapiens
SWWWGVKIAPGGMGSFHAMINSSVHVIMYLYYRLSAFGPVAQPYLWWKKHMTAIQLIQFVLVSLHISQYY

SEQ ID NO: 797049 - protein, 69 aa, Homo sapiens
ALGGARAVWACRLPPRGAACHPHPYPYPYLHPKAYPGLARRSPEIRSGPASGICFPLTSPAEHFGLTNS

SEQ ID NO: 797050 - protein, 86 aa, Homo sapiens
GPSTPSAAAGPGAKSLIAPGQQGWPAAPSAGPAKPTPTRNSSWPASAAGSPSSRSRLSLHTSLQAEGVGSSLGHPGRGGAESKRGL

SEQ ID NO: 797051 - protein, 104 aa, Homo sapiens
TTGPVLGRTMTGALSSWSCSDWRIILGRWFSPGKVCSPGSPANQQGARRWCKNTDLSHLVSPHFPLWSQASGSGHFCQGTSVLQSSQDSPCHPPPRSGSKLAFS

SEQ ID NO: 797052 - protein, 325 aa, Homo sapiens
MSFKDKDERISCLEAYVTLTSKSSRFTDETEILKMSQRHSGQAGTEAGNGADSPPIVNSKYSTFRDFCSTSSFQDSGYNELKSCSFDNIDKEYLGKKEKGPTLLYEHPETSGLGLTHPLESPTQKKKCILPRKEKDKTPELCETPKISGKKCLPRRRLNVSFALLKGDFESQNSSLESSISQVINLEKNIPSSASGFSRANNFSPLVTSTLKTEEVTSCSQKLRLNFSQQKTSTIDDSKDDCSLFEVECISPIQGNNFKDSITHDFSDSSLCINDENACPELLGSSVSGTTCGTDEDIFVTPISNLVANIRFNASQILSPSPEVR

SEQ ID NO: 797053 - protein, 131 aa, Homo sapiens
HGFLDEIFFTFFFNVLGQGDGTTSGHTSLWSFFMYGSCSFVVEKLYFHLHYSRGWGTWKRVPIYVIFIYVWELSWGLGLRTCGACSWDYSHYPLNFMGLITLMYLPGWIFLSVYQDLISNVLWRVQYVPAN

SEQ ID NO: 797054 - protein, 66 aa, Homo sapiens
GCLESGTVGGEQTQERSHSKWLRVPDGRAVQVVLWLASPPPPQLQRGRSARTPCLAGTGPSSQGTE

SEQ ID NO: 797055 - protein, 67 aa, Homo sapiens
IHPIPHSPPRSIWSPLSQDPGSQKSQEQKEEGTKEPAHGCGPSIRGCRKENSLIQPPYQPLSSSPQY

SEQ ID NO: 797056 - protein, 108 aa, Homo sapiens
AGAQAHPDIQSRLLGASGNPVGKGAVAMAPEMLPKHPHTPRDRRPQADTSLHGNLAGAPLPLLAGASTHFPSKRLIKVCSSAPPRPTRRFHTVCSQALSRPVVNAHLH

SEQ ID NO: 797057 - protein, 103 aa, Homo sapiens
YVPCSPLPAPSPCPQVSPVVGDAGPVFLWGTGFGDHPCPDPCSLILSKCLISPPDPYPLILSKCLIFPSGSPGRHLLSRYGAAGICLPNLTLHKSVPSTLSSP

SEQ ID NO: 797058 - protein, 140 aa, Homo sapiens
MGGTDLSNIYPTAIHLTSKDGRPSCSRLSCNGSFAFDGIITLTDVLAINWGLSASNPNSHRWITGSWGAKTLLCLFLLLPEPGQSSPFLDPTLICTELNYTKGCTQECMSEVKCNLWDLMWTFQVRVYKIKERKSWGTPQ

SEQ ID NO: 797059 - protein, 115 aa, Homo sapiens
DIQEGEQDKDCPLKNHPLLATLASALLLPALCTLKRTGAGFIRKGRRGALEVKWVPGGSCTQNGGGGPGSVDGVGGGLAEGARPHFLPQLHLSLSSPSPLPPLTRNKNIIMVLYR

SEQ ID NO: 797060 - protein, 114 aa, Homo sapiens
HEEEAQPTSACTCGQRGAESVKAPPGVGAAKIMATVPPTGAQAGRLGCAASAARPRNVQVRPGARRPQLHPCPSPSGDGGERPGCLRADCLGFHRSPLLEQIPGLGSLCSSWTP

SEQ ID NO: 797061 - protein, 152 aa, Homo sapiens
RWSFTRDGAPLSHMLECNGTVSAHCNLHLPDSSSSSTSASRVAGITGARHHAQLIFVVLAEMGFHHAGQAGLELLSSGDPPTLASQSAGITGTSHHARPPLPSFLSNQNLPIYTTPHSHTCFPFNLLFFFEMESRSCRSGWSAVVRSWLTAS

SEQ ID NO: 797062 - protein, 74 aa, Homo sapiens
GSGRAVCLHTGLPPRTGHRDRDTQGAPQELAPGTLTATPAAPHTMALHGVYFLLSISADSTLSSPPFLCLTVLA

SEQ ID NO: 797063 - protein, 58 aa, Homo sapiens
MAVILFTQLTAPMTVILFTQLTAPMAVILFTQLTAPMAVILFTQLTTPMAVILFTQLT

SEQ ID NO: 797064 - protein, 121 aa, Homo sapiens
AARTPRRELRSSLPSGVCTPGFFPAGGQGPSTTVPPAGHPAPTLPLGGSWFWSRLAHSGCLWTRFLNFSTKDVAAVCSVGSWKIAVLGSSRLSLAPPGPGKINPPLPPDPRAVTWCLVAPL

SEQ ID NO: 797065 - protein, 70 aa, Homo sapiens
DILPRHCTVRAGPEHPAMVRPSRGAPVTHNGCLLLREAELHPGDLLGLGEHFLFMYKDPRTGGSGPARPP

SEQ ID NO: 797066 - protein, 487 aa, Homo sapiens
YCEGMKVLPASGLAVFLIMALKFSTAAPSLVAASPRTWRNNYRLAQAYLDKYYTNKEGHQIGEMVARGSNSMIRKIKELQAFFGLQVTGKLDQTTMNVIKKPRCGVPDVANYRLFPGEPKWKKNTLTYRISKYTPSMSSVEVDKAVEMALQAWSSAVPLSFVRINSGEADIMISFENGDHGDSYPFDGPRGTLAHAFAPGEGLGGDTHFDNPEKWTMGTNGFNLFTVAAHEFGHALGLAHSTDPSALMYPTYKYKNPYGFHLPKDDVKGIQALYGPRKVFLGKPTLPHAPHHKPSIPDLCDSSSSFDAVTMLGKELLLFKDRIFWRRQVHLRTGIRPSTITSSFPQLMSNVDAAYEVAERGTAYFFKGPHYWITRGFQMQGPPRTIYDFGFPRHVQQIDAAVYLREPQKTLFFVGDEYYSYDERKRKMEKDYPKNTEEEFSGVNGQIDAAVELNGYIYFFSGPKTYKYDTEKEDVVSVVKSSSWIGC

SEQ ID NO: 797067 - protein, 140 aa, Homo sapiens
MSNVDAAYEVAERGTAYFFKGPHYWITRGFQMQGPPRTIYDFGFPRHVQQIDAAVYLREPQKTLFFVGDEYYSYDERKRKMEKDYPKNTEEEFSGVNGQIDAAVELNGYIYFFSGPKTYKYDTEKEDVVSVVKSSSWIGC

SEQ ID NO: 797068 - protein, 244 aa, Homo sapiens
MLYPSHEEAMSGPTDETAGDLPVKDTGLNLFGMGGLQETSTTRTMKSRQAVSRVSREELEDRFLRLHDENILLKQHARKQEDKIKRMATKLIRLVNDKKRYERVGGGPKRLGRDVEMEEMIEQLQEKVHELEKQNETLKNRLISAKQQLQTQGYRQTPYNNVQSRINTGRRKANENAGLQECPRKGIKFQDADVAETPHPMFTKYGNSLLEEARGEIRNLENVFRSQRGQIEEVEHWLEIVKIS

SEQ ID NO: 797069 - protein, 235 aa, Homo sapiens
MSGPTDETAGDLPVKDTGLNLFGMGGLQETSTTRTMKSRQAVSRVSREELEDRFLRLHDENILLKQHARKQEDKIKRMATKLIRLVNDKKRYERVGGGPKRLGRDVEMEEMIEQLQEKVHELEKQNETLKNRLISAKQQLQTQGYRQTPYNNVQSRINTGRRKANENAGLQECPRKGIKFQDADVAETPHPMFTKYGNSLLEEARGEIRNLENVFRSQRGQIEEVEHWLEIVKIS

SEQ ID NO: 797070 - protein, 134 aa, Homo sapiens
MLYPSHEEAMSGPTDETAGDLPVKDTGLNLFGMGGLQETSTTRTMKSRQAVSRVSREELEDRFLRLHDENILLKQHARKQEDKIKRFKEKVRQPLKNENRVFLLRIHPKEVVPVQFLLCGLQQPTGMLCAGLLL

SEQ ID NO: 797071 - protein, 107 aa, Homo sapiens
IGKAPLPLGFLFNGWVFPVKVSPCRKSELQRSARSRCLLSHLPVCQVAEDWLCSSTKGHSPCQGTSCPACHLGLFFPPCMFPDLGLAAAPFYWYPRGTVPAMSSCFI

SEQ ID NO: 797072 - protein, 108 aa, Homo sapiens
ILTYSCRDRHCIASGRTPAPKVSPCRKSELQRSARSRCLLSHLPVCQVAEDWLCSSTKGHSPCQGTSCPACHLGLFFPPCMFPDLGLAAAPFYWYPRGTVPAMSSCFI

SEQ ID NO: 797073 - protein, 108 aa, Homo sapiens
PLAAHPGTPRHRMAPHAYLVHPDSRALGPLRQLSGAHPGPAPPHRCALRSPEAADLKMTKGQKTPWLTSSDHPAPSSSCLWFQPDNNPGPQRPLPGRLPTSGQFGPVP

SEQ ID NO: 797074 - protein, 780 aa, Homo sapiens
SLFGSYNTLAFKKQAVGRNLGSPEVWRWCGGSRLGTRTPAMNPPGSLEALDPNVDEHLSTQILAPSVHSDNSQERIQARRLRIAARLEARRREALGEYLDGKKESEEDQSKSYKQKEESRLKLAKLLLCGTELVTNIQVAIDIREIHRRVEEEEIKRQRIEKLENEVKTSQDKFDEITSKWEEGKQKRIPQELWEMLNTQQLHCAGLLEDKNKLISELQQELKTKDDQYVKDLKKQSDDICLLLERMEEQVKNVMKTFREELYNIEKAFEVERQELLASNKKKWEQALQAHNAKELEYLNNRMKKVEDYEKQLNRQRIWDCEEYNMIKIKLEQDVQILEQQLQQRKAIYQLNQEKLEYNLQVLKKRDEESTVIKSQQKRKINRLHDILNNLRSKYAKQIKQFQEENQSLTSDYKRLVMQFKELQKAMRHFALIDDEKFWEIWLMNEEEAKDLIARAFDVDRIIHTHHLGLPWAAPDFWFLNNVGPISQQPQKSATQIVEEMLMRSEEEEAEEAAAEPESYLDLPKQISEKTTKRILMLLCDESGFLIESKLLSLLLPLEQNECYLLRLDAIFSALGIESEDDLYKLVNFFLKYRAHRLSSSLQIKPCSQASMEKASMEETSTRSELELAEQTEMEGEKEESLVEGEKEEEEETPPSPWVIHPNDVLKILEAFVMGLKKPRDSRAPLRVQKNVRDNSKDSEYWQALTTVIPSSKQNLWDALYTALEKYHLVLTQRAKLLLENSSLEQQNTELQALLQQYLNSKINSELQVPPTQVLRVPTK

SEQ ID NO: 797075 - protein, 93 aa, Homo sapiens
SLFGSNTLAFKKQAVGRNLGSPEVWRWCGGSRLGTRTPAMNPPGSLEALDPNVDEHLSTQILAPSVHSDNSQERIQARRLRIAARLEARRRLT

SEQ ID NO: 797076 - protein, 127 aa, Homo sapiens
MSQGLPAAGSVLQRSVAAPGNQPQPQPQQQSPEDDDRKVRRREKNRVAAQRSRKKQTQKADKLHEEYESLEQENTMLRREIGKLTEELKHLTEALKEHEKMCPLLLCPMNFVPVPPRPDPVAGCLPR

SEQ ID NO: 797077 - protein, 76 aa, Homo sapiens
FYASVNPDGEETEQEYESLEQENTMLRREIGKLTEELKHLTEALKEHEKMCPLLLCPMNFVPVPPRPDPVAGCLPR

SEQ ID NO: 797078 - protein, 71 aa, Homo sapiens
VYVCKKCVNEYESLEQENTMLRREIGKLTEELKHLTEALKEHEKMCPLLLCPMNFVPVPPRPDPVAGCLPR

SEQ ID NO: 797079 - protein, 105 aa, Homo sapiens
KRPRAKAAGDGCLSGQCSKGSPGMFGDSAGGSLPALKTCRGQAKKQASKQAAACACCRRRQLWGNLQVLPSACGSSLVLSCFLFSSGGPGISSFLTAPLKIYSNI

SEQ ID NO: 797080 - protein, 320 aa, Homo sapiens
QKRQPLSVSDRHVYKYRCNHCSLAFKTMQKLQIHSQYHAIRAATMCNLCQRSFRTFQALKKHLEAGHPELSEAELQQLYASLPVNGELWAESETMSQDDHGLEQEMEREYEVDHEGKASPVGSDSSSIPDDMGSEPKRTLPFRKGPNFTMEKFLDPSRPYKCTVCKESFTQKNILLVHYNSVSHLHKLKKVLQEASSPVPQETNSNTDNKPYKCSICNVAYSQSSTLEIHMRSVLHQTKARAAKLEPSGHVAGGHSIAANVNSPGQGMLDSMSLAAVNSKDTHLDAKELNKKQTPDLISAQPAHHPPQSPAQIQMQLQHE

SEQ ID NO: 797081 - protein, 77 aa, Homo sapiens
RIPLRCWASAILLPQTSKIARTTGTHPEEEEIPGAHDPRKSHLRTRQEGRHLQAKERGLRRNRTCHTLILDFQPSEL

SEQ ID NO: 797082 - protein, 66 aa, Homo sapiens
AQACPPDVGPGQSRSQEGLRGQQSEAEGFAELRPAVTWRAACLCYCLHSQPGLLGLSMGPAPRRSD

SEQ ID NO: 797083 - protein, 140 aa, Homo sapiens
SAETQKGERGKPHPLRGCDAVNVFLQGKSCFWIFLELQEVLRKLRDCGRCGSAAPPNPPAPVGKVTPPLPASWESDSFLWAEGSGPGGSPRALRVTRGAACSPAPPSGASAHTHLRGRKRRALLCLPHPGPLQFVCPHPG

SEQ ID NO: 797084 - protein, 107 aa, Homo sapiens [sequence omitted]

SEQ ID NO: 797085 - protein, 107 aa, Homo sapiens [sequence omitted]

SEQ ID NO: 797086 - protein, 364 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 797087 - protein, 363 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKMFHLAAFKLKLCKMQLKRKSKQKTISTLRIVFMPPRPALFPFCLFP

SEQ ID NO: 797088 - protein, 401 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKMFHLAAFKLKLCKMQLKRKSKQKTISTLRIVFMPRTKTQWCSLRVYAHECRRLNRHQHIRRLLDPKTIFLFQFHLAFQHVSDTG

SEQ ID NO: 797089 - protein, 372 aa, Homo sapiens
GLGGGWPWLIGRGYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTCSNDNCSNNNEHSNDNDCSDDNDCFNDNERSNDNEHSNNNKCSSDNNVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKMFHLAAFKLKLCKMQLKRKSKQKTISTLRIVFMPRTKTQWCSLRVYAHECRRLNRHQHIRRLLDPKTIFLFQFHLAFQHVSDTG

SEQ ID NO: 797090 - protein, 359 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTCSNDNCSNNNEHSNDNDCSDDNDCFNDNERSNDNEHSNNNKCSSDNNVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 797091 - protein, 401 aa, Homo sapiens; identical to SEQ ID NO: 797088

SEQ ID NO: 797092 - protein, 401 aa, Homo sapiens; identical to SEQ ID NO: 797088

SEQ ID NO: 797093 - protein, 88 aa, Homo sapiens
PIKAAWNGAVPCKGTGAELPKTMGAYFLHQCDLNVRHRVKGDYFGALKFNDYPAGFWTCMGPLALLFCPVLLFGIGASSSNACTLIVS

SEQ ID NO: 797094 - protein, 129 aa, Homo sapiens
GGEKRGSIKPLPLGQPAEHLPGLGPGHTTQVSNESLILKNKRRLTTDPKRKQEYNLRSWWATRGQRLTSIHTALRLASCGYPGPGRVLQSRSRKGTGCSHRTSCHRSGSQGALVLVPTLPLSCLMATGE

SEQ ID NO: 797095 - protein, 52 aa, Homo sapiens
MVSDSPHQLQNVPIPLRLSFCIFITLTLVRFQALFAATLTGTSTFKFLMKSS

SEQ ID NO: 797096 - protein, 156 aa, Homo sapiens
MAPAVTRLLFLQLVLGPTLVMDIKMQIGSRNFYTLSIDYPRVNYPKGFRGYCNGLMSYMRGKMQNSDCPKIHYVIHAPWKAIQKFCKYSDSFCENYNEYCTLTQDSLPITVCSLSHQQPPTSCYYNSTLTNQKLYLLCSRKYEADPIGIAGLYSGI

SEQ ID NO: 797097 - protein, 156 aa, Homo sapiens; identical to SEQ ID NO: 797096

SEQ ID NO: 797098 - protein, 132 aa, Homo sapiens
PRDLEDRSACVPKDYSATRGSFSQRAETRRLSDCLGCVSLCHCCMSGACVSHSLFSLCHSLSVCFSHFLSLCVCVCAPVCVCVYVPSALQSDLMHVRVSFVGSCLRLCLDHVGCCQSFLRRFHFGFLKTSTM

SEQ ID NO: 797099 - protein, 75 aa, Homo sapiens
EDGPKFLKSGDVAIIDMVPGKPMCVESFSDYPPLGCFAACDMRQTVALGVIKAADKKAAGAGKVTKYPQKAQKAK

SEQ ID NO: 797100 - protein, 128 aa, Homo sapiens
KELPTEPPYTAYVGNLPFNTVRGDIDAIFKDLSIRSVRLVRDKDTDKFKGFCYVEFDEVDSLKEALTYDGALLGDRSLRVDIAEGRKQDKGGFGFRKGGPDDRGFRDDFLGGVWAAVLRHFSFAFSLL

SEQ ID NO: 797101 - protein, 126 aa, Homo sapiens
KELPTEPPYTAYVGNLPFNTVRGDIDAIFKDLSIRSVRLVRDKDTDKFKGFCYVEFDEVDSLKEALTYDGALLGDRSLRVDIAEGRKQDKGGFGFRKGGPDDRGFRDDFLGGRGGSRPGDRRTGPP

SEQ ID NO: 797102 - protein, 288 aa, Homo sapiens
MRDRLPDLTACRKNDDGDTVVVVEKDHFMDDFFHQVEEIRNSIDKITQYVEEVKKNHSIILSAPNPEGKIKEELEDLNKEIKKTANKIRAKLKAIEQSFDQDESGNRTSVDLRIRRTQHSVLSRKFVEAMAEYNEAQTLFRERSKGRIQRQLEITGRTTTDDELEEMLESGKPSIFTSDIISDSQITRQALNEIESRHKDIMKLETSIRELHEMFMDMAMFVETQGEMINNIERNVMNATDYVEHAKEETKKAIKYQSKARRKKWIIIAVSVVLVAIIALIIGLSVGK

SEQ ID NO: 797103 - protein, 288 aa, Homo sapiens; identical to SEQ ID NO: 797102

SEQ ID NO: 797104 - protein, 288 aa, Homo sapiens; identical to SEQ ID NO: 797102

SEQ ID NO: 797105 - protein, 79 aa, Homo sapiens
KILLLRQVSDVCRSRERRPQADPPAPQFSMSSHPHPLPERCNPASSADLVMYEFTEEAQPNVLFSDSAVSTVGVMRDPE

SEQ ID NO: 797106 - protein, 269 aa, Homo sapiens
MRDRLPDLTACRKNDDGDTVVVVEKDHFMDDFFHQVEEIRNSIDKITQYVEEVKKNHSIILSAPNPEGKIKEELEDLNKEIKKTANKIRAKLKAIEQSFDQDESGNRTSVDLRIRRTQHSVLSRKFVEAMAEYNEAQTLFRERSKGRIQRQLEITGRTTTDDELEEMLESGKPSIFTSDIISDSQITRQALNEIESRHKDIMKLETSIRELHEMFMDMAMFVETQGEMINNIERNVMNATDYVEHAKEETKKAIKYQSKARRVSLASKN

SEQ ID NO: 797107 - protein, 313 aa, Homo sapiens
MRDRLPDLTACRKNDDGDTVVVVEKDHFMDDFFHQVEEIRNSIDKITQYVEEVKKNHSIILSAPNPEGKIKEELEDLNKEIKKTANKIRAKLKGFRCVQKQREATTSRPPSSTVLHELPPAPAPSYSEAHPRHLDFITIEQSFDQDESGNRTSVDLRIRRTQHSVLSRKFVEAMAEYNEAQTLFRERSKGRIQRQLEITGRTTTDDELEEMLESGKPSIFTSDIISDSQITRQALNEIESRHKDIMKLETSIRELHEMFMDMAMFVETQGEMINNIERNVMNATDYVEHAKEETKKAIKYQSKARRVSLASKN

SEQ ID NO: 797108 - protein, 87 aa, Homo sapiens
QLPLRNFIAGSPGLPRPPQDCTGLPWAGGAALTFHTSPPSCAQAAFWTRDVQASPVPAVSHDNQLTIVLMPKRHVWRCHILVSYNIQ

SEQ ID NO: 797109 - protein, 95 aa, Homo sapiens
WVRLASWRVHPPALLGCSYQLFQHLLEKPYPTPRSVRSHPSPGAATAPQTPDHQLLSINWRNLLVLPRNLSATGAAEAEQMAKGSGSSKAERTCG

SEQ ID NO: 797110 - protein, 102 aa, Homo sapiens
MMDFFNAQMRLGGLTQPLEPVLAVQINQDKNFAFLEVPSGTRLPRYGFDGSSSRQSLKIEGSRLQRSWCRETSLFAGVGCGGPHCPRLGGPHREPAKGTWAR

SEQ ID NO: 797111 - protein, 103 aa, Homo sapiens
AEVAEAAGAGGKARRKLHRALRGRLSMSDFDEFERQLNENKQERDKENRHRKRSHSRSRSRDRKRRSRSRDRRNRDQRSASRDRRRRSKPLTRGAKEEHGGLM

SEQ ID NO: 797112 - protein, 157 aa, Homo sapiens
AEVAEAAGAGGKARRKLHRALRGRLSMSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTLTVWL

SEQ ID NO: 797113 - protein, 77 aa, Homo sapiens
INRLPAGAFFVTCPGESFSPDLKGFSAVGREVLASEAILNVPDKSDWRQCQISKEDEETLARRFRKDFEPYDFTLDD

SEQ ID NO: 797114 - protein, 77 aa, Homo sapiens; identical to SEQ ID NO: 797113

SEQ ID NO: 797115 - protein, 132 aa, Homo sapiens
PPNREKHHRKAFHKLTTAGTWRVEAHETALGKTCGNRKRCVILTTQFVSQVCLVPHPQSLRYFKHLVILPLMAFRKCTDASRCITNAKGPHSKATTWKVKMRIFSISHSRKRKWKNSTFVIKDRDLLLCMGN

SEQ ID NO: 797116 - protein, 113 aa, Homo sapiens
MLMPLDKYLPGDPLLRSRMLGWAHVLTLQIGEPQENLASLRKTTQVLTFEFPGETSGPLPCPQFTYHWRTGRTLFALTGPLVSECPPLSLSHTLTQTHTHMTSNQLSNAPLDS

SEQ ID NO: 797117 - protein, 67 aa, Homo sapiens
SLETAWKDWVPAAERRARRPNAGCGCLQPILPPAPRVIFRNASLIVESTFLTPFSALLFVTPLLYKR

SEQ ID NO: 797118 - protein, 367 aa, Homo sapiens
MDDAAVLKRRGYLLGINLGEGSYAKVKSAYSERLKFNVAIKIIDRKKAPADFLEKFLPREIEILAMLNHCSIIKTYEIFETSHGKVYIVMELAVQGDLLELIKTRGALHEDEARKKFHQLSLAIKYCHDLDVVHRDLKCDNLLLDKDFNIKLSDFSFSKRCLRDDSGRMALSKTFCGSPAYAAPEVLQGIPYQPKVYDIWSLGVILYIMVCGSMPYDDSNIKKMLRIQKEHRVNFPRSKHLTGECKDLIYHMLQPDVNRRLHIDEILSHCWMQPKARGSPSVAINKEGESSRGTEPLWTPEPGSDKKSATKLEPEGEAQPQAQPETKPEGTAMQMSRQSEILGFPSKPSTMETEEGPPQQPPETRAQ

SEQ ID NO: 797119 - protein, 95 aa, Homo sapiens
GRGMSESGQNTTGKVQIHPLRARGTGAACSPPGALFPVGTGREALSLGPGAARTDGGAVLEGSAVTVAHHGISVSLLHAAPTPAARARRQRRGSR

SEQ ID NO: 797120 - protein, 95 aa, Homo sapiens; identical to SEQ ID NO: 797119

SEQ ID NO: 797121 - protein, 68 aa, Homo sapiens
RTLTNNIIPQPPQELTATLTKRKSDTTVTLIAFDNTQYFIGPSAAELEHVVLQIQYFPPNSHHSTFLL

SEQ ID NO: 797122 - protein, 145 aa, Homo sapiens
PESSTKVYTAISAIYCCVTNYSKTQWLKTTHLLSHSFCGLGIRRWAPCFRVSHGLLSRCKLGLISRLNWGRIHFQVHPHDYWQDSFPMNCCQKPLSDPCHVGLSEGQLTTQQLDLSEQAGNEAEQGPLLGTCSTPTLKHRNKEKS

SEQ ID NO: 797123 - protein, 100 aa, Homo sapiens
ITHSASTCFLKKLHHHPPAMRPSPAPRCLPRRIKSKFSCGKKTLHTLVPACLQPSPLCFLSCLILRHPYLPITLTFRAFLKVLRELMSLHLNKIQTLHSR

SEQ ID NO: 797124 - protein, 115 aa, Homo sapiens
DNCLCSPITWYVTEVGAFYLHSTYGSVFMVPLTCHVTIASLQFCTHYSLSLEHFSPPYERNNSYFSRLSSDFTSAAQVFLPSAASLAPRIRGSPLCAPRGLLTHSRSLLCLLHCK

SEQ ID NO: 797125 - protein, 115 aa, Homo sapiens
MRLLARVHAPVLRQVGAHDESLAALGALEGPLTSVRALVLQELRALAESLSALGAGEGLLAAVRAPVLPQPRHTHEGLAAVGTGVWPCARVDLQVLGQVGALAEGLATVPAGVRP

SEQ ID NO: 797126 - protein, 102 aa, Homo sapiens
SHSYLPLSSPLSIPCSQTHSFPSLSPVPAPLLRLNPNPPSLPTPFSSLPVYLSPSLMSSESTAPKSSILNLSHSPVSIPTKNRIGPTYPDTCDSPPHCLLFR

SEQ ID NO: 797127 - protein, 73 aa, Homo sapiens
MLRPLWESRAHGQVPAQDWNGTGLSAALCCRAREHPQDPGLVPSSAGQVVLPGIRAKVEDATGGFHSYFPNLA

SEQ ID NO: 797128 - protein, 97 aa, Homo sapiens
WFSAGTTLASLRTGTLTEHWCQAHARAQKQRKLPCVEGVQTARKKPVLLPGQHGWAAGDRVMRWHRKGKSYLGPGCDTGLGTNEVMSTMGFLNLLPL

SEQ ID NO: 797129 - protein, 79 aa, Homo sapiens
GGDDDDDDDDGDGDDDKDNNELSQTQRLLDVHPGTTWEAFLHSELRGDEHSTAQRSVGFILGAAWGRDKKTTWVPNLGP

SEQ ID NO: 797130 - protein, 220 aa, Homo sapiens
QRSGKHGPGGGGRLVGARAVVVGLRAGAAGRDAVPKREAVAGAEEAGPPLELPRRLLRQTVPWLLGVVVSALLRESGSTMDIPVPSSFNDVGQDWRLRHFVDQMWYEREVTFLEQWTQDLHTRVVLRIVSAHSYAIVWVNGVDALEHEGSTSPLTPTSVACSRWGPCPPASASLSPSATCSSPPPCHQGASSTWPTPPRGYHPASTADTHLPVPPRGALH

SEQ ID NO: 797131 - protein, 220 aa, Homo sapiens; identical to SEQ ID NO: 797130

SEQ ID NO: 797132 - protein, 220 aa, Homo sapiens; identical to SEQ ID NO: 797130

SEQ ID NO: 797133 - protein, 182 aa, Homo sapiens
KNLKAPPPESWNTVSGKKMKKPSTSGQNFHSDVDYRGPKNPSKPIKAPSALPPRLQHPSGVRQHAFSSHSSGSQSQKFSSEHKNLSRTPSQIIRKPDRERVEDFDHTSRESNYFGLSPEERREKQAIEESRLLYEIQNRDEQAFPALSSSSVNQSASQSSNPCVQRKSSHVGDRKGSRRRMD

SEQ ID NO: 797134 - protein, 177 aa, Homo sapiens
KNLKAPPPESWNTVSGKKMKKPSTSGQNFHSDVDYRGPKNPSKPIKAPSALPPRLQHPSGVRQHAFSSHSSGSQSQKFSSEHKNLSRTPSQIIRKPDRERVEDFDHTSRESNYFGLSPEERREKQAIEESRLLYEIQNRDEQAFPALSSSSVNQSASQSSNPCVQRTLCIQSSGCKV

SEQ ID NO: 797135 - protein, 141 aa, Homo sapiens [sequence omitted]

SEQ ID NO: 797136 - protein, 99 aa, Homo sapiens
ALMVPLTAPRREELVLLVGPPSGLGSTMLKPRVRSPPPEASVSIPPLCLPLRVPEYLYKIQASSQPPSASRAAGFVHKYYNHSEFIIITVNDKIPQCQN

SEQ ID NO: 797137 - protein, 78 aa, Homo sapiens
ITRDQYGNHHHHAVGKGLCGGKKKAMWEQEGKCLHLSQVTPGSCTESHPCMYVTSPARSLPQPQLAVAISDPLSVNTS

SEQ ID NO: 797138 - protein, 103 aa, Homo sapiens
SGSTFSLHTLHLFRAQPSSCPSGLHLRPLTSGRDQEEGPEALPAERRPSPCQRPVWLLISLDRSSWRLGQKGRKEQKPTMGRNVLQLQPIGAATANRCNFRDI

SEQ ID NO: 797139 - protein, 108 aa, Homo sapiens [sequence omitted]

SEQ ID NO: 797140 - protein, 61 aa, Homo sapiens
MPQDQPDTWMATGVEGTAKLGCCHQGPDLLSPVQGEPGPHQQHRTGPPSTSGPGQHSPPSS

SEQ ID NO: 797141 - protein, 566 aa, Homo sapiens
MPRGFLVKRTKRTGGLYRVRLAERVFPLLGPQGAPPFLEEAPSASLPGAERATPPTREEPGKGLTAEAAREQSGSPCRAAGVSPGTGGREGAEWRAGGREGPGPSPSPSPSPAKPAGAELRRAFLERCLSSPVSAESFPGGAAAVAAFSCSVAPAAAPTPGEQFLLPLRAPFPEPALQPDPAPLSAALQSLKRAAGGERRGKAPTGCASGPAAAGIKKPKAMRKLSFADEVTTSPVLGLKIKEEEPGAPSRGLGGSRTPLGEFICQLCKEQYADPFALAQHRCSRIVRVEYRCPECDKVFSCPANLASHRRWHKPRPAAANAATVSSADGKPPSSSSSSSRDSGAIASFLAEGKENSRIERTADQHPQARDSSGADQHPDSAPRQGLQVVTHPEPPLPQGPYTEGVLGRRVPVPGSTSGGRGSEIFVCPYCHKKFRRQAYLRKHLSTHEAGSARALAPGFGSERGAPLAFACPLCGAHFPTADIREKHRLWHAVREELLLPALAGAPPETSGPSGPSDGSAQQIFSCKHCPSTFFSSPGLTRHINKCHPSESRQVLLLQMPLRPGC

SEQ ID NO: 797142 - protein, 740 aa, Homo sapiens
LKDSLESDSESLTQEIMCHSEFDDRIRGNGMEPDSLDEEESPRWGSLHEMEEEASGKAAQMAREQNHHTWDQGANNRQQPIEDKYSDLRYDPNWKSKKEEGQLLSVEALPESTDSSLENLPLAPLYPSQETSMELSGGKGEQKESPQSAASLLGSEFLSPNYEHGARRSKPFSELSDSDLEEKSSSLSPYVKSSSSHNEVFLPGSRGPRRRKSKQHFVEKNKLTLGLPTPKTDSYLQLHNKKRGESHPEQISYPVRATDKTSIQNAKEMENAAIDPEDKWHQRAQQLKNYQEHWSQYESTKSSNVPRGQPSDMVNDHQPSRRPAKLKIRKQCKHQNGLKSSTTEEVTASQGNQNNPPRQQQNQNKPLDTSTKPESIVIMHASNNDVQASRALRSHNLKETSNTFAPPKQAFDKVLSKNSTGCDSGLNVNKERGHKDQEEKRFSYQQLHTLSDMDLNNLNELSKRHVLLSQKGSQFVYHINTHGSTKNKKQLKQPYTETKYRNLEMLWKFHSSSDSQTVRASPDSWLTQIMEQHQQALVQLTDVQPSEGALSSVTLPPILSRVESESQLSSERSQRNQVKISRSNSEGYLFQLEKGKKHKKRSSSKNTKLKGYQKRDVKLGGLGPDFESIRDKTQKLIQQKEYAKQVKEYNMKTLSILSKPQTEKTQKKSAIPRQKALEYAKTIPKPKPSNLTHQASKEQKNPTYAGKEESLPEISLLEILQNRHEREKQAVAAFKVLHIV

SEQ ID NO: 797143 - protein, 740 aa, Homo sapiens; identical to SEQ ID NO: 797142

SEQ ID NO: 797144 - protein, 740 aa, Homo sapiens; identical to SEQ ID NO: 797142

SEQ ID NO: 797145 - protein, 50 aa, Homo sapiens
SGVKAEYWGLFWKSEEPNCLIRLQAWATWRDPLSTKIQKLARRCGTHLYS

SEQ ID NO: 797146 - protein, 83 aa, Homo sapiens
RVEVRLGPLRGSVLELRLRQRARGPRTLHKAPEKMTGPGLGAVAHACNPGALGGLGGRIAGVQEFEISLGNKARHHPPPPVAT

SEQ ID NO: 797147 - protein, 146 aa, Homo sapiens
MLTYILRRNNNTTRNPHRHHIYEGIFQEPQKQDYFMSQLVVTSPAPASEKGGASKSSTICQAKYQSLSPLGVYGPISPKMCELVVPPPVDSPAAEQLRVTATQRLEAPLGCEMKKAFFAPDAARASPEAPEASISQLLKSRHISCL

SEQ ID NO: 797148 - protein, 226 aa, Homo sapiens
DGKIVLPGNFLYCTFYGRPYKLQVLRVKGADGMILGGPQSDSDTDAQRMAFEQSSMETSSLELSLQLSQLDLEDTQIPTSRSTPYKPIDDRITNKASDVLLDVTQSPGDGSGLMLEEVTGLKCNFESAREGNEQLTEEERLLKFSIGAKCNTDTFYFISSTTRVNFTEIDKNSKEQDNQFKVTYDMIGGLSSQLKAIREIIELPLKQPELFKSYGMMSSVYCTQKC

SEQ ID NO: 797149 - protein, 316 aa, Homo sapiens
DGKIVLPGNFLYCTFYGRPYKLQVLRVKGADGMILGGPQSDSDTDAQRMAFEQSSMETSSLELSLQLSQLDLEDTQIPTSRSTPYKPIDDRITNKASDVLLDVTQSPGDGSGLMLEEVTGLKCNFESAREGNEQLTEEERLLKFSIGAKCNTDTFYFISSTTRVNFTEIDKNSKEQDNQFKVTYDMIGGLSSQLKAIREIIELPLKQPELFKSYGIPAPRGVLLYGPPGTGKTMIARAVANEVGAYVSVINGPEIISKFYGETEAKLRQIFAEATLRHPSIIFIDELDALCPKREGAQNEVEKRVVASLLTLMDGI

SEQ ID NO: 797150 - protein, 104 aa, Homo sapiens
SHSPCCKQGPKQTGPLPEPCTLHCSVKFQFPISTYHVCVHMCVQMCPHYICAQLCTTNVTFLWDPLMTHNSLSTFCKFFSSLLIYQDCATAVRSPAWATERDSV

SEQ ID NO: 797151 - protein, 117 aa, Homo sapiens
CPWPVSMKLPGEKSLSFPLHPEAPAWAKNVQECGIWRNYTSELPGYIQTAKNRSWPNWDASVEQQICTLLAVMQARWSTSDTQGWLEQCSLGKIHGQGSRNRRKTTHPNVLHTATTL

SEQ ID NO: 797152 - protein, 98 aa, Homo sapiens
RGYRMSNTRALTQWKALTQAQARPLAIKVTHLLATIALLAGSLQWCLRANHHILLSTTFTISGAIYELTPSTSQLSVQTPRKAGQRSDSREKGNSSLS

SEQ ID NO: 797153 - protein, 59 aa, Homo sapiens
MMLGAHGDSQEALAWPIWSLLCEMRLVTPTSRVVGDMDLWPPPQGVPHAPGPDWESGPQ

SEQ ID NO: 797154 - protein, 214 aa, Homo sapiens [sequence omitted]

SEQ ID NO: 797155 - protein, 214 aa, Homo sapiens [sequence omitted]

SEQ ID NO: 797156 - protein, 139 aa, Homo sapiens
MCLSSLRFPFVLTLDLSLPLLLPTLRVRACACLFRHLCDYLPTYHFITLFLVQSSPVSETVHLWPCRCSNLGDFPSLHVVKHFAESPVFKQTSPGHCVGIWHTTSLIVYPVVLFYKRVSLSQGMRVTCLQELLPRFQEM

SEQ ID NO: 797157 - protein, 171 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 797158 - protein, 127 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 797159 - protein, 132 aa, Homo sapiens
IFECFTGPCSPYSSSVVWIHFQEVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 797160 - protein, 138 aa, Homo sapiens
RGAARVEKLYLFGVSRFAPSTLMVWFFPGVSPFKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 797161 - protein, 171 aa, Homo sapiens; identical to SEQ ID NO: 797157

SEQ ID NO: 797162 - protein, 171 aa, Homo sapiens; identical to SEQ ID NO: 797157

SEQ ID NO: 797163 - protein, 153 aa, Homo sapiens [sequence omitted]

SEQ ID NO: 797164 - protein, 171 aa, Homo sapiens; identical to SEQ ID NO: 797157

SEQ ID NO: 797165 - protein, 127 aa, Homo sapiens; identical to SEQ ID NO: 797158

SEQ ID NO: 797166 - protein, 133 aa, Homo sapiens
AGGGAASPVDCSRDSWCLFWVPVDKLAATSSSLRSIKALGSARAGQRMARGQRGQRGGGMTSCREEYSLLIAGDNGMAGCREELPSPLRAAETTCQQREATLSRASSPLRTEHWTDDLPTERSYPLWASSELF

SEQ ID NO: 797167 - protein, 134 aa, Homo sapiens
MGQHTHPVSVPWSFLGKFQTRKQWGSGHITPKYDCRRPEYATPKYDYRRPEYVTPKYDCRRPEYATPKYDCRRPEYATPKYDCRRPEYATPKYDCRRLEYVTPKYDCRRPEYVTPKYDCRRPEYVTPKYAMLTC

SEQ ID NO: 797168 - protein, 140 aa, Homo sapiens [sequence omitted]

SEQ ID NO: 797169 - protein, 105 aa, Homo sapiens
QGLRDAPGEGQQQAAARARQRRSAPSRSSRRPTVAAAPGHFFLKLSKLPPSSPTPPAAKEKQKKKRKEARKETQICHHNEKKKGKRKRRESRATVGLDGGRQSVG

SEQ ID NO: 797170 - protein, 218 aa, Homo sapiens
MCLVTVLGNLIIILDVSPDSHLPTPMYFFLSNLSLPDIGFTSTTVPKMIVDIQSHSRVIFYAGRLTQMSLFAIFGGMEEDTLLSVMAYDRFVAICHPLCHSASMNPCFCGFLVLLSFFFLSLLDTQLHNLIALQMTCFKDVEILNFFCDPSQLPHLACCDTFTNNIIMYFPAAIFGFLQISGTLFSYYKIVSSILRVSSSGGNYKAFSTCGSHLSVVC

SEQ ID NO: 797171 - protein, 117 aa, Homo sapiens
GALTFSMPGARHLSPLPPQGQPGLGHLAWRQTVDSPVPKFGAFEALVLPFSSPPRVKWELAHRQLLCLSKKPAEEFLVSRSSPSGPGFSGPTASTVGRSNKRPGIPRNILLPSSSAY

SEQ ID NO: 797172 - protein, 124 aa, Homo sapiens [sequence omitted]

SEQ ID NO: 797173 - protein, 184 aa, Homo sapiens
TPSSETSSSSCKKQAASMAVVIPDAVLKEGLSGDALSSPSAPEPVVGIPDNKLDADYIKRYLGDLTPLQESCLIRLHGWLQETHKGEIPKDEHILQFLCAWDFNIDKAREIICQSLAWRKQHQVDYILATWAVPQVLQNYYTGGWHHHDKDGWPLCMLRLGQMDTNGLVRALGEEALLRYVLSI

SEQ ID NO: 797174 - protein, 88 aa, Homo sapiens
GGGAEALAPRLCGVRAILSQSLECIPEPDLITPPRTLVFWGIDLLQPVMDLKHMRKPIHSFTLGLQNHPSCTGAVLYISSESSPAPLC

SEQ ID NO: 797175 - protein, 134 aa, Homo sapiens
PQTIRFQPTVEERPLKTGIWSELGLRAYVYPVNPPPPSPEAPSHKNGGEGAVPEAEAAQYQPVPAPTLGPAVIPEFSRHRSSGRIVYDARDMRRRLRELTREVEALSGCYPLASGSSTAEETSKNWVYRSLTGR

SEQ ID NO: 797176 - protein, 34 aa, Homo sapiens
QEGLERWPGDSAHRFGTVEELYTHRLNWRVCKLK

SEQ ID NO: 797177 - protein, 73 aa, Homo sapiens
LRALRPPTPPGKEPHSPTRRQQTPHPWLSEQQALILENPLLKFSLTTWTREGGNILYWALTTCQTHLILRKLL

SEQ ID NO: 797178 - protein, 84 aa, Homo sapiens
SDVTARWDSRSPDARWDSVQSSSTVARPTAPFTSVPPFPHLGRARTSEALGGRKLREGGACLETWTPTEWICWHLDLREGGTED

SEQ ID NO: 797179 - protein, 67 aa, Homo sapiens
ALPKRQQKLKNVIACALGSPGTANIKRLTVASADKDGEQLELSSTAGGHAKWDSHFRKQLVVSYKLK

SEQ ID NO: 797180 - protein, 71 aa, Homo sapiens
GSLCWAQGGGHICCLKGLPRSIPGGAVSAPPALQAPHSVPALLPGGCSPALGARASRSFGGSAGGAQTCGS

SEQ ID NO: 797181 - protein, 598 aa, Homo sapiens [sequence omitted]

SEQ ID NO: 797182 - protein, 753 aa, Homo sapiens [sequence omitted]

SEQ ID NO: 797183 - protein, 753 aa, Homo sapiens
MGSGTSTQHHFAFQNAERAFKAAALIQRWYRRYVARLEMRRRCTWSIFQSIEYAGQQDQVKLHDFFSYLMDHFIPSSHNDRDFLTRIFTEDRFAQDSEMKKCSDYESIEVPDSYTGPSLSFPLLPDHATALVEAFRLKQSLALSSRLEYSGAISAHCNIRFLGSSDSPASASCQLHARYVLNLLYETKKHLVQLPNINRVSTCYSEEITVCGDLHGQLDDLIFIFYKNGLPSPERSYVFNGDFVDRGKDSVEILMILFAFMLVYPKEFHLNRGNHEDHMVNLRYGFTKEVMNKYKVHGKEILRTLQDVFCWLPLATLIDEKVLILHGGVSDITDLELLDKIERSKIVSTMRCKTRQKSEKQMEEKRRANQKSSAQGPIPWFLPESRSLPSSPLRLGSYKAQKTSRSSSIPCSGSLDGRELSRQVRSSVELELERCRQQAGLLVTGEKEEPSRSASEADSEAGELRKPTQEEWRQVVDILWSDPMAQEGCKANTIRGGGCYFGPDVTQQLLQKYNLQFLIRSHECKPEGYEFCHNRKVLTIFSASNYYEVGSNRGAYVKLGPALTPHIVQYQANKVTHTLTMRQRISRVEESALRALREKLFAHSSDLLSEFKKHDADKVGLITLSDWAAAVESVLHLGLPWRMLRPQLVNSSADNMLEYKSWLKNLAKEQLSRENIQSSLLETLYRNRSNLETIFRIIDSDHSGKGTHYSITFEALQVFYLKPLISFLIHPHSSPLRHLESKVRRLVLINDRN

SEQ ID NO: 797184 - protein, 106 aa, Homo sapiens
PSNGESDCFNLFETGFYHSELNPMNMCSEESERPAKRLKMGIAVPESFMNEVSVNNLGVDFENHTHHITSAKMAVSVADFGSLSANETNGFISAHALHQHAALHSE

SEQ ID NO: 797185 - protein, 238 aa, Homo sapiens
LVILEVKVLGPEYPILALVGEEVEFPCHLWPQLDAQQMEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIAGQWLLAHTHLPSPHVYIHIGPKGSL

SEQ ID NO: 797186 - protein, 103 aa, Homo sapiens
RGLCLLIFSIGYCFLSFLMRKNDKSKINKLATTYENPQEIPFPEFSLTNLANITNGNRPHVSATIAVSCRGKRLGGNLHFSSATATNRNERARGFCKISTPEN

SEQ ID NO: 797187 - protein, 103 aa, Homo sapiens; identical to SEQ ID NO: 797186

SEQ ID NO: 797188 - protein, 75 aa, Homo sapiens
KDFLSSSDRGSEQEDLEDSGSMDCSAPSVIQGDSSKRADKDEIPTISSYVDKNTKDRFPVFSHRIWNLPYYHPSS

SEQ ID NO: 797189 - protein, 104 aa, Homo sapiens
SRTMKEPISVGEGSPSVVPCPGSPRNLTSGPSASLASLCLPLFFSSESNTLSVRQPGGKGFSEKLQPACSLGMYTGVEPQKFTVFAAGRSLATPLPGWNLEFIL

SEQ ID NO: 797190 - protein, 99 aa, Homo sapiens
VSGRNRIVELEESWGGGAQAGDVALSMAAEQVHGQAGLEPKLPALTCTQSASRIRAPGRQVGIWRCTEMKCPSLLPGPPPSGTPLETTSAPTLPASPLG

SEQ ID NO: 797191 - protein, 96 aa, Homo sapiens
AGSSCLALGNIFPLQPRASTRLPRWIRPQRCVPASFLILSLKRSRDFSAAPQNTTQNFLVNGRIRKWMAWLTELRNSSWKFSANVLLVQHLQWWPT

SEQ ID NO: 797192 - protein, 121 aa, Homo sapiens
AELFFTERTPWFHQFPQIPVAPDLSSRGTRRKDFLSTRRILGAAKVPVVSFYHSRGVLLKASERASGGSKAVQPGRKVRNIVGKKRHQNHRIERKIIEEMYLPVRVKLAFRGRRGLAFFDI

SEQ ID NO: 797193 - protein, 109 aa, Homo sapiens
TAASRMAGFSFTCFISVIHPLSPQPSSKNRNGYSRLGMAPRRLPSPTRRAAGSPRVSWGLRPARPSFQAFPGSPVRPALILDYLHFKNPPNFFLWPITLSSYIRASFVK

SEQ ID NO: 797194 - protein, 110 aa, Homo sapiens
HHHHHHHNHLQIDAQVILEEISRTGALLQLCNPWASLCTAPHVLISMLIKPPHLIPCLLQGEVPQAGVCPVYRLNMHFAQWLEMCWWWNVLVIVSGWRATAPQCSAMTDS

SEQ ID NO: 797195 - protein, 113 aa, Homo sapiens
SRSARMRLLRTGYKIENKILATEPALNWVNTQAILTILTKLGQADNCWLMLSIFFTEYKYNITKVLTENCNLLEEFKTQGYTDCIEHEQLIKIKGNKEFCKERLDTALLHQSH

SEQ ID NO: 797196 - protein, 142 aa, Homo sapiens
MDTVLKAKCWKLSMMLRCLYKNMSHCTQLLEIYLYSSLGIGGSIKVVDSRAWWLTPVIPALWEAEAGGSPDIGVRDQPGQHGETPSLPKNTKISQVWWQMPIIPATQEAEAGESLEPRRRLQWTEIMPLHSSLGYRARLRLK

SEQ ID NO: 797197 - protein, 142 aa, Homo sapiens [sequence omitted]

SEQ ID NO: 797198 - protein, 74 aa, Homo sapiens
QRDSALCSRTHRCMRRRRPASSKEESQGTEHREAALPPASSQTADALRPRSSARTPPGPISSPPSKPHFSRVQP

SEQ ID NO: 797199 - protein, 109 aa, Homo sapiens
MTTAGKTNQKLEWAFSLYDVDGNGTISKNEVLEIVMAIFKMITPEDVKLLPDDENTPEKRAEKIWKYFGKNDDDKLTEKEFIEGTLANKEILRLIQFEPQKVKEKMKNA

SEQ ID NO: 797200 - protein, 109 aa, Homo sapiens; identical to SEQ ID NO: 797199

SEQ ID NO: 797201 - protein, 77 aa, Homo sapiens
MTLNKGLPRPEPQCLYLTSDSKDTDVSCTFPALNGLCATHLLHLLQIHSFSSFNTCIYSVPSALPGTKNKALNKIDT

SEQ ID NO: 797202 - protein, 115 aa, Homo sapiens
TQPAWCCTTGLTPQIKTTGAQPQPTDEGMQGVQDAGQREKRGMSHGCAPRSEPDGALNGFSCPGSSHHILNAVFLPLQGNLLLTSGTLQPRTYQHSDSFLVLTHYPFNIALDSIY

SEQ ID NO: 797203 - protein, 134 aa, Homo sapiens
FFLLRQCFTLVTQAGVQWRDLSSPQPPPPGFKQFSYLSLPSSWNYRHVPPRPANFVFLVETGFLHVGQAGLELPTSGDPPASASQNTGITGVSHRAWLFTHFLKPCLSIHLTSVKFSMTPVLQHVERKLHESSN

SEQ ID NO: 797204 - protein, 146 aa, Homo sapiens
KKRKKKSSYTEARSAKQIAASRPTPWQQLRPGLSGDGVCKRIPAQESGLLFLMKAADATLCALCRTVPGTWTDLASPCASEGRTALCLRSPAGGRTGVLLSSFAHRVEHLQLLGPSCLSAGPRYLLPLVFHCDVHHFLELQLVFIC

SEQ ID NO: 797205 - protein, 138 aa, Homo sapiens [sequence omitted]

SEQ ID NO: 797206 - protein, 86 aa, Homo sapiens
STGKQGPSLPRSVPGGSGHCLHLGGGQHMCVGTCWKEGMTLLAMERWSSVSHGLRRCLPNVQVTIASELRHAASGMHSPFTAKHSA

SEQ ID NO: 797207 - protein, 156 aa, Homo sapiens
SLGLAPARPQVALLRPSLPQAQSSLCESPGCEPDFEPSVTMPLLSTRWPQILATSLGARLLLEKGTQRKGWEARLLLALSPDRTYRLSRGDLCAPVAFSGFLGWEGGLLPPRIPPMRSSSFVPGWVGTVVFFPQTVSLGGGGRAYRYIGTASAPKS

SEQ ID NO: 797208 - protein, 109 aa, Homo sapiens
MKCSELYPCNLCTRSHSFPYSKSDSATFSSPLQHHSHPLYWVIPTTSLVEATISPLPDSCSSLLPGLLLAPAPFHFIFIAIARMIPLKSTLAQNPPEASHSLSIKVKIS

SEQ ID NO: 797209 - protein, 135 aa, Homo sapiens
TERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLV

SEQ ID NO: 797210 - protein, 76 aa, Homo sapiens
VSYHVMLFQCKPGAYRVLNWNKPAEYIYHLISTIYYLLFDISKHSSSNAYSLREETLTYMYHQSKQHNVGQYTYLL

SEQ ID NO: 797211 - protein, 91 aa, Homo sapiens
VRLPQHPRLHALKPGWPTHTSLPPSLKLHLFRVTHRFEAVMKTGNPLSMSVIICTQNSACNVVGSMPPEDHQWSHPHYTSSLSPDYEAHER

SEQ ID NO: 797212 - protein, 80 aa, Homo sapiens
YEKFTLPLLYQRYGKRQTLTRPTKPPATEITKSILLDETTSASAEVFPRPCPQTALSGSSPARASGCPCGNLSDTAASPW

SEQ ID NO: 797213 - protein, 107 aa, Homo sapiens
SLLRTGYKIENKILATEPALNWVNTQAILTILTKLGQADNCWLMLSIFFTEYKYNITKVLTENCNLLEEFKTQGYTDCIEHEQLIKIKGNKEFCKERLDTALLHQSH

SEQ ID NO: 797214 - protein, 125 aa, Homo sapiens
KAPDFVFYAPRLRINKRILQLCMGNHELYMRRRKPDTIEVQQMNAQAREEKHQKQLERQQLETEKTRNGETDLEKGQSWNIFWAQVDPDTGGPEKASLKQRGTGHFGGGNWATKQPYGEANVERN

SEQ ID NO: 797215 - protein, 68 aa, Homo sapiens
QSVGKNLQRVNRVLMGPRSIQERHFKKVGKHSTRKEQDAQAFVDNAAKGKRLEGPAPRELEQPHSPAF

SEQ ID NO: 797216 - protein, 38 aa, Homo sapiens
MTAQHGPSKPQSHREASPPGPCVAVLEPVVSCEERSGR

SEQ ID NO: 797217 - protein, 111 aa, Homo sapiens
FLEVTCIPCHMTPSILKASDRDLLACQTSSYIRSLSNFLFCYQPEKTLCFYFYLFFYLLRQSLTLSPRMECNGAISAHYNLRLPGSSDSPASATRKAEAGEWHEPGRRSLH

SEQ ID NO: 797218 - protein, 106 aa, Homo sapiens
MASMYRRHKTSRVGRVKSWRARGYPGEHAGQTAPSACPHDPLLQSEGQDTMRPLRHRVHPRHDPDERQECVPCFCPRSSLKGTHLCKPTALPAASTASESSGAPYP

SEQ ID NO: 797219 - protein, 69 aa, Homo sapiens
GRTHLSHQLPLPALPGPGACLTYTPFAGPRNRLPPAGLGGASETARPSSDCRASDQEIARSLRSSFVES

SEQ ID NO: 797220 - protein, 94 aa, Homo sapiens
VLFLSARETFQGAVAASPIQGDAAPWGHRCFLGSPEHFSVLLASHPIGQALESGHCLELTRRCFTVVLGLSLRGLGPLCCEAGLQLWWQVTRCH

SEQ ID NO: 797221 - protein, 104 aa, Homo sapiens
LFLPLSLLFSLSLLLICSILYMGLVPSTANKENDHLETQKAHHIPAEPPQLKETQLLSPASTHQSRPELHLTLVRHASTPRWTTEAREFSIMMGTSGVMGLPCS

SEQ ID NO: 797222 - protein, 108 aa, Homo sapiens
QIQTVAKLHLKRSPGRGPVLAPEESTQHHPPEVAGPGVLQAAPFGRFCFPRKWGKYFKPGEGRKLTLKYVLFLKIKCKCMEAGCPFSGFGTGVLESNRVGVQALSDSG

SEQ ID NO: 797223 - protein, 180 aa, Homo sapiens
ENLRWLRLGDRYTACRPRGSLHPPSRGGVRWKVMQPSWTPAPVQRTACNITAWGGEFGKEGEGRCEQVALSSGPPEGALHASREGPQPPGAENLRPSTGETFVQSGRWDGGWRGAMKGRRHRQASTPPTRPESIFVPTAQDGAQMVCKAHTRTTQYTEQDSVVTARGLLDAKRVGVAGGS

SEQ ID NO: 797224 - protein, 83 aa, Homo sapiens
VPEPELDPGPQPEPKPEPESAAGEPGAHEPQTQRCPGEVGRREGRPLLPAASRDGGPHHPWNCWPLCVARDFSRGFASRGYFS

SEQ ID NO: 797225 - protein, 143 aa, Homo sapiens
VPEPELDPGPQPEPKPEPESAAGEPGAHEPQTQRCPGGVRDAGLGAQGLRGGGAQGGGGRVLRSLLLACVGPPGGAGQRKARKVRSLRGSARSSFLRPGHSHSRRHRVLPHPTGGINPLLWLRAPQEGSSLGGTGHGPAKGTT

SEQ ID NO: 797226 - protein, 76 aa, Homo sapiens
WVGAQHPTPPAAPRDNRRCFLEELRGRGMRDGSWVSGRDPTLHVMPCKVCGDPKKKRPGSVIYFPGKPIEKQLDSK

SEQ ID NO: 797227 - protein, 111 aa, Homo sapiens
MGAEEGTGIGFWMHFGGSMKESGVKGSSEALAASLIHLHPFCQGHLSFLLGTVSRPPRCCPPDQQWPFQAFHLLPSSLSLRSQVPFPTHLFLKCVALLWVQDCSSDQGSSR

SEQ ID NO: 797228 - protein, 115 aa, Homo sapiens [sequence omitted]

SEQ ID NO: 797229 - protein, 115 aa, Homo sapiens
ARLVEGSAELLTRACGGPRPALAPVVAAAGWLPGRLPPAAAVGAICSSPHPESWTPRTAPWRACVKCSSGAVRRLPEKLGAESGSFWSRERLGKLRNVDLQGLEELSAWAVPVGH

SEQ ID NO: 797230 - protein, 157 aa, Homo sapiens
TQQGGDAARRHPLHKVPARAAELGPRRLDAPRFPRPPGHRALPRAARHPPSRPPWRRRGPGALLPGAGVIRVLLLLPVAFLGVGGILALIGPVAAPGLEDDPPAPSHFREQREAVGSPAMRRRTVTVGGPRRSRVCDTLPPPPAWGGSAGQRVRWAR

SEQ ID NO: 797231 - protein, 132 aa, Homo sapiens
AVLCMVRLLAASPNSTHCMPAALPIPQVMTVCLQTVPNFPRGQNLQLGTITLEKCKEARDCSSFFFFNNKPCRTICLFHLCACHTFIKIRTKEREREAHESLIMNSSVGKALLKNNRPGTVTHAYNPISLGD

SEQ ID NO: 797232 - protein, 78 aa, Homo sapiens
YGGAHGGGGARGGGGARGGGGARGGGGARGGGGARGGGGARGGGALSMEVLMVVEVLVVVEVPVVVEVLVVWRCPWWW

SEQ ID NO: 797233 - protein, 343 aa, Homo sapiens
MGKQQSKLKHSTYKYGPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 797234 - protein, 318 aa, Homo sapiens
MGKQQSKLKHSTYKYGPDEIIEERIQTKAFQEYSPAHMDTVSVVAALNSDLCVSGGKDKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 797235 - protein, 343 aa, Homo sapiens; identical to SEQ ID NO: 797233

SEQ ID NO: 797236 - protein, 343 aa, Homo sapiens; identical to SEQ ID NO: 797233

SEQ ID NO: 797237 - protein, 343 aa, Homo sapiens; identical to SEQ ID NO: 797233

SEQ ID NO: 797238 - protein, 77 aa, Homo sapiens
QERQDSGLGPPHLSTLTSSEISSFLRSHHIQHHPYVGSSQFPPARSSLPVLGRIYPITYLAFPPGSSVDSSNMVGPK

SEQ ID NO: 797239 - protein, 206 aa, Homo sapiens
MLQSMLISGQSIPDELVIKLMLEKLNSPEVCHFGYIITEIPSLSQDAMTTLQQIELIKNLNLKPDVIINIKCPDYDLCQRISGQRQHNNTGYIYSRDQWDPEVIENHRKKKKEAQKDGKGEEEEEEEEQEEEEAFIAEMQMVAEILHHLVQRPEDYLENVENIVKLYKETILQTLEEVMAEHNPQYLIELNGNKPAEELFMIVWID

SEQ ID NO: 797240 - protein, 336 aa, Homo sapiens
LEAVASLRRVRLRPVFCVMTSQEKTEEYPFADIFDEDETERNFLLSKPVCFVVFGKPGVGKTTLARYITQAWKCIRVEALPILEEQIAAETESGVMLQSMLISGQSIPDELVIKLMLEKLNSPEVCHFGYIITEIPSLSQDAMTTLQQIELIKNLNLKPDVIINIKCPDYDLCQRISGQRQHNNTGYIYSRDQWDPEVIENHRKKKKEAQKDGKGEEEEEEEEQEEEEAFIAEMQMVAEILHHLVQRPEDYLENVENIVKLYKETILQTLEEVMAEHNPQYLIELNGNKPAEELFMVSAVLSRNTSQHGKFKSIDSIVLLLINRSIFIFEHHLSLN

SEQ ID NO: 797241 - protein, 318 aa, Homo sapiens
MTSQEKTEEYPFADIFDEDETERNFLLSKPVCFVVFGKPGVGKTTLARYITQAWKCIRVEALPILEEQIAAETESGVMLQSMLISGQSIPDELVIKLMLEKLNSPEVCHFGYIITEIPSLSQDAMTTLQQIELIKNLNLKPDVIINIKCPDYDLCQRISGQRQHNNTGYIYSRDQWDPEVIENHRKKKKEAQKDGKGEEEEEEEEQEEEEAFIAEMQMVAEILHHLVQRPEDYLENVENIVKLYKETILQTLEEVMAEHNPQYLIELNGNKPAEELFMVSAVLSRNTSQHGKFKSIDSIVLLLINRSIFIFEHHLSLN

SEQ ID NO: 797242 - protein, 103 aa, Homo sapiens
HGLWVGVVHSLLLLLAVGEGFFGSVLILGAPSPTPFVSSPGSSHLPNQSQCRNLDTSVQGAEFTVLFIQGKTAASHWASWPAHFTSLFVKSTPLQEYPLLNFA

SEQ ID NO: 797243 - protein, 117 aa, Homo sapiens
SPKPVDPLKESGNLCPSHPASLPTSTLDEAQNPCQGSRYQRVTLRLLGLEANTGKDSIAFLLKWRQAALSLGPPISISEAHHGCCTHILSAQTQTKISQQQRNKVFSLCSHYLPGRN

SEQ ID NO: 797244 - protein, 254 aa, Homo sapiens
HIPVSDQGKQGTALGRMDKHGVKTPLWKKETEELRAEDAEQEEGKEGSEDEDEDNQRPLEDSATEGEEPPRVAEEGEGRERRSVSYCPLRQESSTQQVALLRRADSGFWGWLGPLALLGGLTAPTDRKRSLPEEPCVLEIRRRPPRRGGCACCELLFCKKCRSLHSHPAYVAHCVLDHPDLGKGGGPLGTPERPRSQPLCPPSFPGPRPPTDLLSWSAEPSSTHSAGPPLLSCCPERPHPSRRPTVGAWFPSVT

SEQ ID NO: 797245 - protein, 193 aa, Homo sapiens
LTSQSLIRESRAQPWEEWISMQDCPDLLPARRCEDPLVEEGNGRAPGRGRGARGREGGVGGRGRGQPEAAGGQRDGGRGAAAGSGGGRRPRAALSVLLPAAPGVQHPAGGAAAARGQRLLGLARPLSAAGRPNSSHRQEAEPPGGAVRAGDPATTAAPRGLCLLRAPLLQEMQESAQPPSLCGALRSGSPGSG

SEQ ID NO: 797246 - protein, 81 aa, Homo sapiens
QSLQAFRAPEDERSPMLRKVTVVTACPMGLRWPKGDNRRGPDSGGKGLMTANHAFSSQCPSQQPPSGSTKQATVRVFTPWE

SEQ ID NO: 797247 - protein, 66 aa, Homo sapiens
VPGSIQGLKHPRRKELVPQSFASVRPHLVRKRPRTPRSEASPLSSPALGVSLTVVSTDPRFLLKAC

SEQ ID NO: 797248 - protein, 148 aa, Homo sapiens
TPLLLAPFSPASLVSLMFLKCDKLTPAPGSLHHWFSCLQYFLQMAPRLASSFFQSSAQYQRLHNTFLDCPVINGNPMSPELPMPLSCILKFHSMYPHLIFYIRLFVYCPSHRLEPEFHESENCMPSSPLQLGRGPAKGMNETLLNKYL

SEQ ID NO: 797249 - protein, 154 aa, Homo sapiens
KTHVQMSEEMLLVSRIPQWGCRGLSTLPQGREKLSVPRMWNHTQPYRDWGAQSICPLWVQSPPVGLQAALHHASFALVLHPPRSACQLPLFFCIPQSTHCRVGETACDQENLTVWCVNRIPWSGKPNILFKSERVTIKAICQLPIFKRQRNTHC

SEQ ID NO: 797250 - protein, 35 aa, Homo sapiens
MHDRGARAPSAAGPQDRGLAAQRATGQPGRAHAPC

SEQ ID NO: 797251 - protein, 66 aa, Homo sapiens
ILDKKLRTIQESWSKDTVSSTMDLSTSTPREAEEEPLVPEMSHDTIRLQLNRKLNIFWREKRSGNR

SEQ ID NO: 797252 - protein, 80 aa, Homo sapiens
DAAASPSAVKMLGASRTGISNMRALENDFFNSPPRKTVQFGGTVTEVLLKYKTGETNDFELLKNQLLDPDIKVINFVFDH

SEQ ID NO: 797253 - protein, 244 aa, Homo sapiens
DAAASPSAVKMLGASRTGISNMRALENDFFNSPPRKTVQFGGTVTEVLLKYKTGETNDFELLKNQLLDPDMKGDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPLTPWFLMPILVEKFPFVRKSERTLECYVHNLLRISVYFPTLRHEILELIIEKLLKLD

SEQ ID NO: 797254 - protein, 132 aa, Homo sapiens
RKERKRQEVKETEKETERGRNRESKRKRQREGVREKEGQTQKVRESEREEETKKKSKRKRDGSSKEKTVYPIPLKARVNFCLPSQGMFFLGGTSTYICLPTNWTGTCTLVFLSPNINIAPGNQTLSVPLKAQ

SEQ ID NO: 797255 - protein, 99 aa, Homo sapiens
LLPPSQILPAHLGGEEKTPMGPQQMGTGWEQRERRRGEEVKKKNKNKQQRPSESREAGNMQSPETQPVQLTSQIECCQKPASQEGRRSEGHMAVSFQTV

SEQ ID NO: 797256 - protein, 137 aa, Homo sapiens
MVSPVSKDATEDLRKATGPLEAQALVKQDLLPADQAQVLNEMAKYQVPQRSGDIVMIQSEHTGAIDVLSADLESADLLGDHRKVSPPLMAPPCIWTFAKVKEFKSKLGKEKNSRLVVKRGEVVTIRVPTHPEGKRVC

SEQ ID NO: 797257 - protein, 110 aa, Homo sapiens
MDGRGAFWTVAIPRARQEGLGRLGLPFPVKRTPPAPQNPGGSTQAPQRVVGKSHSGIRMPAKSRNLRLESKLNRKVVKYKWGKQGSGAGRELVPAFPTNAGLGRRDRCRP

SEQ ID NO: 797258 - protein, 255 aa, Homo sapiens
MHPEPSEPATGGAAELDCAQEPGVEESAGDHGSAGRGGCKEEINDPKEICVGSSDTSYHSQQKQSGDNGSGGHFAHPREDREDRGPRMTKSSLQKLCKQHKLYITPALNDTLYLHFKGFDRIENLEEYTGLRCLWLQSNGIQKIENLEAQTELRCLFLQMNLLRKIENLEPLQKLDALNLSNNYIKTIENLSCLPVLNTLQMAHNHLETVEDIQHLQECLRLCVLDLSHNKLSDPIWPQYVPPVFPSVREGYRFH

SEQ ID NO: 797259 - protein, 168 aa, Homo sapiens
MTKSSLQKLCKQHKLYITPALNDTLYLHFKGFDRIENLEEYTGLRCLWLQSNGIQKIENLEAQTELRCLFLQMNLLRKIENLEPLQKLDALNLSNNYIKTIENLSCLPVLNTLQMAHNHLETVEDIQHLQECLRLCVLDLSHNKLSDPIWPQYVPPVFPSVREGYRFH

SEQ ID NO: 797260 - protein, 243 aa, Homo sapiens
MHPEPSEPATGGAAELDCAQEPGVEESAGDHGSAGRGGCKEEINDPKEICVGSSDTSYHSQQKQSGDNGSGGHFAHPREDREDRGPRMTKSSLQKLCKQHKLYITPALNDTLYLHFKGFDRIENLEEYTGLRCLWLQSNGIQKIENLEAQTELRCLFLQMNLLRKIENLEPLQKLDALNLSNNYIKTIENLSCLPVLNTLQMAHNHLETVEDIQHLQECLRLCVLDLSHNKLSDPARRPGLTS

SEQ ID NO: 797261 - protein, 41 aa, Homo sapiens
MMWELASRGPGMLKRLCTVQSVVPEQVKGAAKDSYCYFDVQ

SEQ ID NO: 797262 - protein, 142 aa, Homo sapiens
MSILRYGLNETDLERVSEKEIFMACPLAPDLTAPGQGINSTLQMSVLYFEALRHFMRPLYSGIHCLTTADIHNAMKNGEPLLIYLLIMIPLTSSPLFPSSSLFPQPNKKLKQIHIFVLFFAYLVLLSYSLMCAPVVSATLEV

SEQ ID NO: 797263 - protein, 237 aa, Homo sapiens
MPARLETCISDLDCASSSGSDLSGFLTDEEDCARLQQAASASGPPAPARRGAPNISRASEVPGAQDDEQERRRRRGRTRVRSEALLHSLRRSRRVKANDRERNRMHNLNAALDALRSVLPSFPDDTKLTKIETLRFAYNYIWALAETLRLADQGLPGGGARERLLPPQCVPCLPGPPSPASDAESWGSGAAAASPLSDPSSPAASEDFTYRPGDPVFSFPSLPKDLLHTTPCFIPYH

SEQ ID NO: 797264 - protein, 107 aa, Homo sapiens
CGPDGAVPLRVASWDCPHGSAAPPFSHATGQGRVSDASVQCDGVKRAQEGSEACAGQRLGTMGSGAAGCGYSPRTLPKTRWSTYANFPTVTFPCIRCGNKPFYSYPK

SEQ ID NO: 797265 - protein, 105 aa, Homo sapiens
MSTAPGLHISKIEVLIFSSGPAPPASSPSQLTSVASFRCSGRNPQHRSLFSSHILHQEILLALRPSNCAQNVAPPQHLQCYHRDGPRCHHLSPALLQVSLFPAQP

SEQ ID NO: 797266 - protein, 130 aa, Homo sapiens
MVKVVNFMLCDFTSEISPKVLGFQLMSTAPGLHISKIEVLIFSSGPAPPASSPSQLTSVASFRCSGRNPQHRSLFSSHILHQEILLALRPSNCAQNVAPPQHLQCYHRDGPRCHHLSPALLQVSLFPAQP

SEQ ID NO: 797267 - protein, 105 aa, Homo sapiens; identical to SEQ ID NO: 797265

SEQ ID NO: 797268 - protein, 81 aa, Homo sapiens
MTKESCCTSMPLGSRSVVIKTLLEPERYSLMTTSRSFWSISPCMAETVKSWACIFWVSQSSFLQVLMKMTAWVMVRVSFKS

SEQ ID NO: 797269 - protein, 135 aa, Homo sapiens
LSLHIRYHYIYSITAYTLSLHIPYHCIYPITTYTLSLHILYHYIYTITTYTLSLHILYHCIYSITAYTLSLHILYIYAITTYTLSLHILYHCIHSTYMLSLHILYHCIHSITAYTLSLHTLYHYIYAITAYTLSL

SEQ ID NO: 797270 - protein, 118 aa, Homo sapiens
WGQGLGHGACRGKDEDEEWMPVTKLGYLVKDMKIKSLEEIQPFSLTIEESEIIDFFLGASLKDEVLKTTPVQKQTCADQHTRFKKPVFAFQMSLNLLRKSLPTSLGGQEDEQENFSKL

SEQ ID NO: 797271 - protein, 111 aa, Homo sapiens
WGQGLGHGACRGKDEDEEWMPVTKLGYLVKDMKIKSLEEIQPFSLTIEESEIIDFFLGASLKDEVLKTTPVQKQTCADQHTRFKMSLNLLRKSLPTSLGGQEDEQENFSKL

SEQ ID NO: 797272 - protein, 4349 aa, Homo sapiens
MTIALLGFAIFLLHCATCEKPLEGILSSSAWHFTHSHYNATIYENSSPKTYVESFEKMGIYLAEPQWAVRYRIISGDVANVFKTEEYVVGNFCFLRIRTKSSNTALLNREVRDSYTLIIQATEKTLELEALTRVVVHILDQNDLKPLFSPPSYRVTISEDMPLKSPICKVTATDADLGQNAEFYYAFNTRSEMFAIHPTSGVVTVAGKLNVTWRGKHELQVLAVDRMRKISEGNGFGSLAALVVHVEPALRKPPAIASVVVTPPDSNDGTTYATVLVDANSSGAEVESVEVVGGDPGKHFKAIKSYARSNEFSLVSVKDINWMEYLHGFNLSLQARSGSGPYFYSQIRGFHLPPSKLSSLKFEKAVYRVQLSEFSPPGSRVVMVRVTPAFPNLQYVLKPSSENVGFKLNARTGLITTTKLMDFHDRAHYQLHIRTSPGQASTVVVIDIVDCNNHAPLFNRSSYDGTLDENIPPGTSVLAVTATDRDHGENGYVTYSIAGPKALPFSIDPYLGIISTSKPMDYELMKRIYTFRVRASDWGSPFRREKEVSIFLQLRNLNDNQPMFEEVNCTGSIRQDWPVGKSIMTMSAIDVDELQNLKYEIVSGNELEYFDLNHFSGVISLKRPFINLTAGQPTSYSLKITASDGKNYASPTTLNITVVKDPHFEVPVTCDKTGVLTQFTKTILHFIGLQNQESSDEEFTSLSTYQINHYTPQFEDHFPQSIDVLESVPINTPLARLAATDPDAGFNGKLVYVIADGNEEGCFDIELETGLLTVAAPLDYEATNFYILNVTVYDLGTPQKSSWKLLTVNVKDWNDNAPRFPPGGYQLTISEDTEVGTTIAELTTKDADSEDNGRVRYTLLSPTEKFSLHPLTGELVVTGHLDRESEPRYILKVEARDQPSKGHQLFSVTDLIITLEDVNDNSPQCITEHNRLKVPEDLPPGTVLTFLDASDPDLGPAGEVRYVLMDGAHGTFRVDLMTGALILERELDFERRAGYNLSLWASDGGRPLARRTLCHVEVIVLDVNENLHPPHFASFVHQGQVQENSPSGTQVIVVAAQDDDSGLDGELQYFLRAGTGLAAFSINQDTGMIQTLAPLDREFASYYWLTVLAVDRGSVPLSSVTEVYIEVTDANDNPPQMSQAVFYPSIQEDAPVGTSVLQLDAWDPDSSSKGKLTFNITSGNYMGFFMIHPVTGLLSTAQQLDRENKDEHILEVTVLDNGEPSLKSTSRVVVGILDVNDNPPIFSHKLFNVRLPERLSPVSPGPVYRLVASDLDEGLNGRVTYSIEDSDEEAFSIDLVTGVVSSSSTFTAGEYNILTIKATDSGQPPLSASVRLHIEWIPWPRPSSIPLAFDETYYSFTVMETDPVNHMVGVISVEGRPGLFWFNISGGDKDMDFDIEKTTGSIVIARPLDTRRRSNYNLTVEVTDGSRTIATQVHIFMIANINHHRPQFLETRYEVRVPQDTVPGVELLRVQAIDQDKGKSLIYTIHGSQDPGSASLFQLDPSSGVLVTVGKLDLGSGPSQHTLTVMVRDQEIPIKRNFVWVTIHVEDGNLHPPRFTQLHYEASVPDTIAPGTELLQVRAMDADRGVNAEVHYSLLKGNSEGFFNINALLGIITLAQKLDQANHAPHTLTVKAEDQGSPQWHDLATVIIHVYPSDRSAPIFSKSEYFVEIPESIPVGSPILLVSAMSPSEVTYELREGNKDGVFSMNSYSGLISTQKKLDHEKISSYQLKIRGSNMAGAFTDVMVVVDIIDENDNAPMFLKSTFVGQISEAAPLYSMIMDKNNNPFVIHASDSDKEANSLLVYKILEPEALKFFKIDPSMGTLTIVSEMDYESMPSFQFCVYVHDQGSPVLFAPRPAQVIIHVRDVNDSPPRFSEQIYEVAIVGPIHPGMELLMVRASDEDSEVNYSIKTGNADEAVTIHPVTGSISVLNPAFLGLSRKLTIRASDGLYQDTALVKISLTQVLDKSLQFDQDVYWAAVKENLQDRKALVILGAQGNHLNDTLSYFLLNGTDMFHMVQSAGVLQTRGVAFDREQQDTHELAVEVRDNRTPQRVAQGLVRVSIEDVNDNPPKFKHLPYYTIIQDGTEPGDVLFQVSATDEDLGTNGAVTYEFAEDYTYFRIDPYLGDISLKKPFDYQALNKYHLKVIARDGGTPSLQSEEEVLVTVRNKSNPLFQSPYYKVRVPENITLYTPILHTQARSPEGLRLIYNIVEEEPLMLFTTDFKTGVLTVTGPLDYESKTKHVFTVRATDTALGSFSEATVEVLVEDVNDNPPTFSQLVYTTSISEGLPAQTPVIQLLASDQDSGRNRDVSYQIVEDGSDVSKFFQINGSTGEMSTVQELDYEAQQHFHVKVRAMDKGDPPLTGETLVVVNVSDINDNPPEFRQPQYEANVSELATCGHLVLKVQAIDPDSRDTSRLEYLILSGNQDRHFFINSSSGIISMFNLCKKHLDSSYNLRVGASDGVFRATVPVYINTTNANKYSPEFQQHLYEAELAENAMVGTKVIDLLAIDKDSGPYGTIDYTIINKLASEKFSINPNGQIATLQKLDRENSTERVIAIKVMARDGGGRVAFCTVKIILTDENDNPPQFKASEYTVSIQSNVSKDSPVIQVLAYDADEGQNADVTYSVNPEDLVKDVIEINPVTGVVKVKDSLVGLENQTLDFFIKAQDGGPPHWNSLVPVRLQVVPKKVSLPKFSEPLYTFSAPEDLPEGSEIGIVKAVAAQDPVIYSLVRGTTPESNKDGVFSLDPDTGVIKVRKPMDHESTKLYQIDVMAHCLQNTDVVSLVSVNIQVGDVNDNRPVFEADPYKAVLTENMPVGTSVIQVTAIDKDTGRDGQVSYRLSADPGSNVHELFAIDSESGWITTLQELDCETCQTYHFHVVAYDHGQTIQLSSQALVQVSITDENDNAPRFASEEYRGSVVENSEPGELVATLKTLDADISEQNRQVTCYITEGDPLGQFGISQVGDEWRISSRKTLDREHTAKYLLRVTASDGKFQASVTVEIFVLDVNDNSPQCSQLLYTGKVHEDVFPGHFILKVSATDLDTDTNAQITYSLHGPGAHEFKLDPHTGELTTLTALDRERKDVFNLVAKATDGGGRSCQADITLHVEDVNDNAPRFFPSHCAVAVFDNTTVKTPVAVVFARDPDQGANAQVVYSLPDSAEGHFSIDATTGVIRLEKPLQVRPQAPLELTVRASDLGTPIPLSTLGTVTVSVVGLEDYLPVFLNTEHSVQVPEDAPPGTEVLQLATLTRPGAEKTGYRVVSGNEQGRFRLDARTGILYVNASLDFETSPKYFLSIECSRKSSSSLSDVTTVMVNITDVNEHRPQFPQDPYSTRVLENALVGDVILTVSATDEDGPLNSDITYSLIGGNQLGHFTIHPKKGELQVAKALDREQASSYSLKLRATDSGQPPLHEDTDIAIQVADVNDNPPRFFQLNYSTTVQENSPIGSKVLQLILSDPDSPENGPPYSFRITKGNNGSAFRVTPDGWLVTAEGLSRRAQEWYQLQIQASDSGIPPLSSLTSVRVHVTEQSHYAPSALPLEIFITVGEDEFQGGMVGKIHATDRDPQDTLTYSLAEEETLGRHFSVGAPDGKIIAAQGLPRGHYSFNVTVSDGTFTTTAGVHVYVWHVGQEALQQAMWMGFYQLTPEELVSDHWRNLQRFLSHKLDIKRANIHLASLQPAEAVAGVDVLLVFEGHSGTFYEFQELASIITHSAKEMEHSVGVQMRSAMPMVPCQGPTCQGQICHNTVHLDPKVGPTYSTARLSILTPRHHLQRSCSCNGTATRFSGQSYVRYRAPAARNWHIHFYLKTLQPQAILLFTNETASVSLKLASGVPQLEYHCLGGFYGNLSSQRHVNDHEWHSILVEEMDASIRLMVDSMGNTSLVVPENCRGLRPERHLLLGGLILLHSSSNVSQGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQELLIITVAVAFIIISTVGLLFYCRRCKSHKPVAMEDPDLLARSVGVDTQAMPAIELNPLSASSCNNLNQPEPSKASVPNELVTFGPNSKQRPVVCSVPPRLPPAAVPSHSDNEPVIKRTWSSEEMVYPGGAMVWPPTYSRNERWEYPHSEVTQGPLPPSAHRHSTPVVMPEPNGLYGGFPFPLEMENKRAPLPPRYSNQNLEDLMPSRPPSPRERLVAPCLNEYTAISYYHSQFRQGGGGPCLADGGYKGVGMRLSRAGPSYAVCEVEGAPLAGQGQPRVPPNYEGSDMVESDYGSCEEVMF

SEQ ID NO: 797273 - protein, 66 aa, Homo sapiens
MGSQEPGMVAAIPPGQEPTKSFLVEDPWAIKDPNSAHDGIWGSAGAMEGKGAPSGLTAMMSLSVRP

SEQ ID NO: 797274 - protein, 72 aa, Homo sapiens
DDRGESVTSAKAQREEKEMQMEHTLKVGSESGKSVVRMSEGISTREDAFKITKSKHHRCSVVTRITETMLEL

SEQ ID NO: 797275 - protein, 44 aa, Homo sapiens
MTERPQIVFQWESENKESEGLLAEAVLSSHLGPGGDYGGPGSGW

SEQ ID NO: 797276 - protein, 132 aa, Homo sapiens
GLNSQSSDDHLNKRSRSSSMSSLTGAYTSGIPSSSRNAITSSYSSTRGISQLWKRNGPSSSPFSSPASSRSQTPERPAKKIREEEMCHHSSSSTPLAADKESQGEKGRLLSQEEGLLLVVEVFVEDVEINTY

SEQ ID NO: 797277 - protein, 137 aa, Homo sapiens
LVHCWWKYRLVQSLWTIVRRFLKKLKLELPKTQQSLLWMYPKEIKSSPHKDICTAIFIAALFTVAKIWKPPRYVLVHEWIKETVVYVYTMEYYSALKKEKTLSFATTCMDLEDIKLWEISPTHIHTQNCIISLICGI

SEQ ID NO: 797278 - protein, 119 aa, Homo sapiens
WCDCILSCQVCRRSFPSCLRRKGWGGGGGICSLLRGSTSGLCTLILSFADGTLFPPTYNGSKGPESEANRAGHGQGQVCVVRQKGNSCQQAKGVGAVGDEAPQGEAVSSHSTPPHKPLI

SEQ ID NO: 797279 - protein, 33 aa, Homo sapiens
MNNVPGFTRAAAGKWPFKFVFKKEVLRLGVVAL

SEQ ID NO: 797280 - protein, 1324 aa, Homo sapiens
MSRRKQAKPQHFQSDPEVASLPRRDGDTEKGQPSRPTKSKDAHVCGRCCAEFFELSDLLLHKKNCTKNQLVLIVNENPGSPPETFSPSPPPDNPDEQMNDTVNKTDQVDCSDLSEHNGLDREESMEVEAPVANKSGSGTSSGSHSSTAPSSSSSSSSSSGGGGSSSTGTSAITTSLPQLGDLTTLGNFSVINSNVIIENLQSTKVAVAQFSQEARCGGASGGKLAVPALMEQLLALQQQQIHQLQLIEQIRHQILLLASQNADLPTSSSPSQGTLRTSANPLSTLSSHLSQQLAAAAGLAQSLASQSASISGVKQLPPIQLPQSSSGNTIIPSNSGSSPNMNILAAAVTTPSSEKVASSAGASHVSNPAVSSSSSPAFAISSLLSPASNPLLPQQASANSVFPSPLPNIGTTAEDLNSLSALAQQRKSKPPNVTAFEAKSTSDEAFFKHKCRFCAKVFGSDSALQIHLRSHTGERPFKCNICGNRFSTKGNLKVHFQRHKEKYPHIQMNPYPVPEHLDNIPTSTGIPYGMSIPPEKPVTSWLDTKPVLPTLTTSVGLPLPPSLPSLIPFIKTEEPAPIPISHSATSPPGSVKSDSGGPESATRNLGGLPEEAEGSTLPPSGGKSEESGMVTNSVPTASSSVLSSPAADCGPAGSATTFTNPLLPLMSEQFKAKFPFGGLLDSAQASETSKLQQLVENIDKKATDPNECIICHRVLSCQSALKMHYRTHTGERPFKCKICGRAFTTKGNLKTHYSVHRAMPPLRVQHSCPICQKKFTNAVVLQQHIRMHMGGQIPNTPVPDSYSESMESDTGSFDEKNFDDLDNFSDENMEDCPEGSIPDTPKSADASQDSLSSSPLPLEMSSIAALENQMKMINAGLAEQLQASLKSVENGSIEGDVLTNDSSSVGGDMESQSAGSPAISESTSSMQALSPSNSTQEFHKSPSIEEKPQRAVPSEFANGLSPTPVNGGALDLTSSHAEKIIKEDSLGILFPFRDRGKFKNTACDICGKTFACQSALDIHYRSHTKERPFICTVCNRGFSTKGNLKQHMLTHQMRDLPSQLFEPSSNLGPNQNSAVIPANSLSSLIKTEVNGFVHVSPQDSKDTPTSHVPSGPLSSSATSPVLLPALPRRTPKQHYCNTCGKTFSSSSALQIHERTHTGEKPFACTICGRAFTTKGNLKVHMGTHMWNSTPARRGRRLSVDGPMTFLGGNPVKFPEMFQKDLAARSGSGDPSSFWNQYAAALSNGLAMKANEISVIQNGGIPPIPGSLGSGNSSPISGLTGNLERLQNSEPNAPLAGLEKMASSENGTNFRFTRFVEDSKEIVTS

SEQ ID NO: 797281 - protein, 176 aa, Homo sapiens
MFEPACRGGSKRSLNISNPTPKWPRSPGEMVHMGTHMWNSTPARRGRRLSVDGPMTFLGGNPVKFPEMFQKDLAARSGSGDPSSFWNQYAAALSNGLAMKANEISVIQNGGIPPIPGSLGSGNSSPISGLTGNLERLQNSEPNAPLAGLEKMASSENGTNFRFTRFVEDSKEIVTS

SEQ ID NO: 797282 - protein, 121 aa, Homo sapiens
CQVKGRDSDTHRLQESKAVDLTFFIIEQFLPNQLRFQCLPSQKNETRFCKLMFVIRILGELFNTVQLMKQFSDTSSKIIATLSSSNLIIKTYLLVTRLLILIILTPCCQIVLIRNPHAESI

SEQ ID NO: 797283 - protein, 74 aa, Homo sapiens
CLSKACTGPASASQRTLHAQLALASLRPPQSTAPAFRPLRQVQLLPASGLFRPSSFLTTAFPGPVFPFWQPLGL

SEQ ID NO: 797284 - protein, 148 aa, Homo sapiens
MALPFLPRSFPCQTSGPYLGICHHPPPPRHTHSHASCKTVTEDLKKTTRAGDSRTCRLRGKPGVHTKELDLLGTQAGGQVRRELGSSKPSETQGTVDSVTSRMVINSCIIPLPSQATIPEPWPHGACIFRIQTPWVPAPYCLHFPLTP

SEQ ID NO: 797285 - protein, 155 aa, Homo sapiens
MGSAGRRPACSDQWALSCQTHNCQMLLKSKTGTLKVEIMLGQIYSHMCTHNLHIHMCAHTQHTYTPYTQLTHIHVHTQHTYTLIHKLTHTHVRTHTYTHTHLTHTHVHTHTLIHNLHMCTHAQHTYTPIHTTYTYTCAHIHNIHMHSYTTYTCTC

SEQ ID NO: 797286 - protein, 98 aa, Homo sapiens
MSGLGPSLSHTPTLAHSLASAIHSPPPHPNSPASSILILSRHQAVWGTGMHTCAPAHTRGRALGPRGHFSQAPIVTHGDGRHGSMSPGPPLSPGISPV

SEQ ID NO: 797287 - protein, 279 aa, Homo sapiens
CCSCSMGNGELHCPSIEPIANTSTSEPVIPSFEKNNHCVSRCNSQSCILAQEEEQYLQSGDQQLTRHVLLCLLLIIGLFANLSSCLWWLFNQEPGRLYVELQFFCAVFNFGQGFISFGIFGLDKHLIILPFKRRLEFLWNNKDTAENRDSPVSEEIKMTCQQFIHYHRDLCIRNIVKERRCGAKTSAGTFCGCDLVSWLIEVGLASDRGEAVIYGDRLVQGGVIQHITNEYEFRDEYLFYRFLQKSPEQSPPAINANTLQQERYKEIEHSSPPSHSPKT

SEQ ID NO: 797288 - protein, 216 aa, Homo sapiens
KFHFVDLAGSERVLKTGSTGERLKESIQINSSLLALGNVISALGDPQRRGSHIPYRDSKITLVSCPLAPMWPGGRGGGECPAHQWGWKPRSPEVSSPREPRQEPVPGLARWPWAWSVGAPESLPLRALRILKDSLGGNAKTVMIACVSPSSSDFDETLNTLNYASRAQNIRNRATVNWRPEAERPPEETASGARGPPRHRSETRIIHRGRRAPGPA

SEQ ID NO: 797289 - protein, 181 aa, Homo sapiens
MKKHSARVAPLSACNSPVLTLTKVEGEERPRDSPGPAEAQAPAGVEAGGRASRRCWTCSRAQLKKIFWGVAVVLCVCSSWAGSTQLAKLTFRKFDAPFTLTWFATNWNFLFFPLYYVGHVCKSTEKQSVKQRYRECCRFFGDNGLTLKVFFTKAAPFGVLWTLTNYLYLHAIKKINTTDVS

SEQ ID NO: 797290 - protein, 118 aa, Homo sapiens
SYTNLQLLDSQKRDPPGTQEATHGQQDHSRPSRPMVGTLLTICGDVAFLQKLCHINVKLVLDVIEGFGIILLRHKSDGQVFSAKATCTGHWVEVGVRVFRHAIVKTMLNHSIPTMVRK

SEQ ID NO: 797291 - protein, 74 aa, Homo sapiens
PAHFGPRVAAGACTQMQPPMAMAPGVRQSREESWKEETQGQEGMGLKLQEGVLLMGPAFWPLLAYPWADPPGKN

SEQ ID NO: 797292 - protein, 88 aa, Homo sapiens
VKHQVPNPAQSRRAKRDIQHVLPLHEMWPSEPALANGLCMGVTHAASRLVSKTSHVSSACSSHLQGARQLWKTQISDGRTIDGRNLGP

SEQ ID NO: 797293 - protein, 77 aa, Homo sapiens
MVDGEGSAKIQYAWVDSEGSAKTQYAWVDGEGSAKIQYAWVDGEGSAKIQYAWVDGEGSAKTQYAWVDGEGSAEIQY

SEQ ID NO: 797294 - protein, 194 aa, Homo sapiens
DRVSVTQAGVQWISAHCNFHLLGLSDSPASASRVAWTTGAHHHARPTFFVFLVETGFHMLARLVRTDITYPAGFMDVISIDKMGENFCLICDTKGHFAVHRITPEEAKYKLCKVRKIFVRTKGIPHLVTHDARTICYPDPLIKVNDTIQIDLETGKITDFIRFDTGNLCMVTGGANLGRIGVITNRERHPGSLD

SEQ ID NO: 797295 - protein, 346 aa, Homo sapiens
MPRGQKSTLHAREKRQQTRGQTQDHQGAQITATNKKKVSFSSPLILGATIQKKSAGRSRSALKKPQRALSTTTSVDVSYKKSYKGANSKIEKKQSFSQGLSSTVQSRTDPLIMKTNMLVQFLMEMYKMKKPIMKADMLKIVQKSHKNCFPEILKKASFNMEVVFGVDLKKVDSTKDSYVLVSKMDLPNNGTVTRGRGFPKTGLLLNLLGVIFMKGNCATEEKIWEFLNKMRIYDGKKHFIFGEPRKLITQDLVKLKYLEYRQVPNSNPARYEFLWGPRAHAETSKMKVLEFWAKVNKTVPSAFQFWYEEALRDEEERVQAAAMLNDGSSAMGRKCSKAKASSSSHA

SEQ ID NO: 797296 - protein, 534 aa, Homo sapiens
MLQQLLITLPTEASTWVKLRHPKAATERVALWEDVTKMFKAEALLSQDADETQGESLESRVTLGSLTAESQELLTFKDVSVDFTQEEWGQLAPAHRNLYREVMLENYGNLVSVGCQLSKPGVISQLEKGEEPWLMERDISGVPSSDLKSKTKTKESALQNDISWEELHCGLMMERFTKGSSMYSTLGRISKCNKLESQQENQRMGKGQIPLMCKKTFTQERGQESNRFEKRINVKSEVMPGPIGLPRKRDRKYDTPGKRSRYNIDLVNHSRSYTKMKTFECNICEKIFKQLIHLTEHMRIHTGEKPFRCKECGKAFSQSSSLIPHQRIHTGEKPYECKECGKTFRHPSSLTQHVRIHTGEKPYECRVCEKAFSQSIGLIQHLRTHVREKPFTCKDCGKAFFQIRHLRQHEIIHTGVKPYICNVCSKTFSHSTYLTQHQRTHTGERPYKCKECGKAFSQRIHLSIHQRVHTGVKPYECSHCGKAFRHDSSFAKHQRIHTGEKPYDCNECGKAFSCSSSLIRHCKTHLRNTFSNVV

SEQ ID NO: 797297 - protein, 432 aa, Homo sapiens
MLENYGNLVSVGCQLSKPGVISQLEKGEEPWLMERDISGVPSSDLKSKTKTKESALQNDISWEELHCGLMMERFTKGSSMYSTLGRISKCNKLESQQENQRMGKGQIPLMCKKTFTQERGQESNRFEKRINVKSEVMPGPIGLPRKRDRKYDTPGKRSRYNIDLVNHSRSYTKMKTFECNICEKIFKQLIHLTEHMRIHTGEKPFRCKECGKAFSQSSSLIPHQRIHTGEKPYECKECGKTFRHPSSLTQHVRIHTGEKPYECRVCEKAFSQSIGLIQHLRTHVREKPFTCKDCGKAFFQIRHLRQHEIIHTGVKPYICNVCSKTFSHSTYLTQHQRTHTGERPYKCKECGKAFSQRIHLSIHQRVHTGVKPYECSHCGKAFRHDSSFAKHQRIHTGEKPYDCNECGKAFSCSSSLIRHCKTHLRNTFSNVV

SEQ ID NO: 797298 - protein, 352 aa, Homo sapiens
FDGDSRISKCNKLESQQENQRMGKGQIPLMCKKTFTQERGQESNRFEKRINVKSEVMPGPIGLPRKRDRKYDTPGKRSRYNIDLVNHSRSYTKMKTFECNICEKIFKQLIHLTEHMRIHTGEKPFRCKECGKAFSQSSSLIPHQRIHTGEKPYECKECGKTFRHPSSLTQHVRIHTGEKPYECRVCEKAFSQSIGLIQHLRTHVREKPFTCKDCGKAFFQIRHLRQHEIIHTGVKPYICNVCSKTFSHSTYLTQHQRTHTGERPYKCKECGKAFSQRIHLSIHQRVHTGVKPYECSHCGKAFRHDSSFAKHQRIHTGEKPYDCNECGKAFSCSSSLIRHCKTHLRNTFSNVV

SEQ ID NO: 797299 - protein, 56 aa, Homo sapiens
MRKRKKLMPSLTIPLSWMQKSWTEPLTLHRPASTHQVLTKDSRTRCWCPVHFIDKE

SEQ ID NO: 797300 - protein, 213 aa, Homo sapiens
MSETDHIASTSSDKNVGKTPELKEDSCNLFSGNESSKLENESKLLSLNTDKTLCQPNEHNNRIEAQENYIPDHGGGEDSCAKTDTGSENSEQIANFPSGNFAKHISKTNETEQKVTQILVELRSSTFPESANEKTYSESPYDTDCTKKFISKIKSVSASEDLLEEIESELLSTEFAEHRVPNGMNKGEHALVLFEKCVQDKYLQQEHIIKKLS

SEQ ID NO: 797301 - protein, 213 aa, Homo sapiens; identical to SEQ ID NO: 797300

SEQ ID NO: 797302 - protein, 121 aa, Homo sapiens
PQGQRGFAGAGAGRGCIPAPGCGESWPCRVHVTDAPSPGPEASARGTDCLAARGPLQILRLCRSSPLPAHRLAPALRERRGQSAGVRPWASKPECRGFKYWVICATLGRLPKQDRILKFVC

SEQ ID NO: 797303 - protein, 90 aa, Homo sapiens
WRVQWQGPQGCRQSHVPIGPAAVRMGRKVTAHPLEPSDGQGTLNSLPHTAGGWGPRYGALACGLKQSAPGKNKLRDTSSGLLAGCNLNVV

SEQ ID NO: 797304 - protein, 39 aa, Homo sapiens
GILLCMEPAHFLGIRQVLFPTPTTSRICNHGPPNSLPVA

SEQ ID NO: 797305 - protein, 343 aa, Homo sapiens
MSPLCFMVWSCCVFVFPDCMLTRALSQSCALSLSPSLPLSPVPRRHKPHDKATRPPAQQKARPPPEDRTQEHPENASAAQKKQKTEHDRTSQPPQERETKTHDTQADEKDTHTAQRKPHNHTDRPQKTRGDRQQERASAGTAQRQRGTAATDKHEHAGQSNAHTHPHGRSTSSPRASSPTHRTPEGHTHAHNRHAENAAQRARPGAAQGPQRARATRTTRRRRHRRPRKDSSEGRAPAPQAGGGQHASGHRPDARGDENKNRRKPREKTTQAANKKHKDKKQKRPTRKTDRRRETGPEKGTTTVREQTQTQKESRERGEGRRQKKEAKATQENNKNSHRDKGR

SEQ ID NO: 797306 - protein, 684 aa, Homo sapiens
NCYQVREESDIISLSQEPDEHPGDIFFKQTPTKDILTELYKLTTERERLLTNLLSSDHILGITMGNQEGKLQELSVSLAPEDDCFQSAGDWQGELPVGPLNKRSTHGNKKPRRSSGRRESFGALPQKRTKRKGRGGRESAPLMGKDKICSSHSLPLSRTRPNLWVLEEKGNLLPNGALACSLQRRESCPPDIPKTPDTDLGFGSFETAFKDTGLGREVLPPDCSSTEAGGDGIRRPPSGLEHQQTGLSESHQDPEKHPEAEKDEMEKPAKRTCKQKPVSKVVAKVQDLSSQVQRVVKTHSKGKETIAIRPAAHAEFVPKADLLTLPGAEAGAHGSRRQGKERQGDRSSQSPAGETASISSVSASAEGAVNKVPLKVIESEKLDEAPEGKRLGFPVHTSVPHTRPETRNKRRAGLPLGGHKSLFLDLPHKVGPDSSQPRGDKKKPSPPAPAALGKVFNNSASQSSTHKQTSPVPSPLSPRLPSPQQHHRILRLPALPGEREAALNDSPCRKSRVFSGCVSADTLEPPSSAKVTETKGASPAFLRAGQPRLVPGETLEKSLGPGKTTAEPQHQSPPGISSEGFPWDGFNEQTPKDLPNRDGGAWVLGYRAGPACPFLLHEEREKSNRSELYLDLHPDHSLTEQDDRTPGRLQAVWPPPKTKDTEEKVGLKYTEAEYQAAILHLKRE

SEQ ID NO: 797307 - protein, 397 aa, Homo sapiens
MGSYKSAGHREGNHMVDIGDIIFTLNELQEQYEDVSITEGSPLNEITSDRKLSSVAGCYLKYKKKNSLSSKLPEPSISKKLNKKSNQYYSKIMENDDLESKRPKNTWQIRKFLGGVGSSNVGVQEPYSKNGINFKKHSEKGEIHDSKSKPQSLKSSTSLSKSLDKSDISSIPKLQKPAVRKHSSLQKQVSSTEKTAISTLENFCEAISKLQENYIAAEELQSILPSTGINLLDEEFQKIVTDTSRNENGMVELDDFVNALAKERSFPECNALPGVIKAIDKIKDKNVDYEDLNTCLQNFGIYLSKPEFKKITELTEAGETKKVNFKEFIDTMMSNTECFSEKLVLPDAIETLDDLRKETMSVSDLWNTLSSLNSNLKKDEFLAALELVTVDGECYKY

SEQ ID NO: 797308 - protein, 417 aa, Homo sapiens
MGSYKSAGHREGNHMVDIGDIIFTLNELQEQYEDVSITEGSPLNEITSDRKLSSVAGCYLKYKKKNSLSSKLPEPSISKKLNKKSNQYYSKIMENDDLESKRPKNTWQIRKFLGGVGSSNVGVQEPYSKNGINFKKHSEKGEIHDSKSKPQSLKSSTSLSKSLDKSDISSIPKLQKPAVRKHSSLQKQVSSTEKTAISTLENFCEAISKLQENYIAAEELQSILPSTGINLLDEEFQKIVTDTSRNENGMVELDDFVNALAKERSFPECNALPGVIKAIDKIKDKNVDYEDLNTCLQNFGIYLSKPEFKKITELTEAGETKKVNFKEFIDTMMSNTECFSEKLVLPDAIETLDDLRKETMSVSDLWNTLSSLNSNLKKDEFLAALELVTVDDNMEVDLKDFLMKMKESPHFQKSKGK

SEQ ID NO: 797309 - protein, 116 aa, Homo sapiens
DFIAIESGSQREGESWKMGMEWERILPLKYCHQAVPLKSSCCSPTQTAVSDVQLLLLFSALCQWSLGFLWVQDTGWGRPGVVLEKAIFEQDPALFLCTISVPPVPLSLYRMSQKSP

SEQ ID NO: 797310 - protein, 101 aa, Homo sapiens
DFIAIESGSQREGESWKMGMEWERILPLKYCHQAVPLKSSCCSPTQTAVSDVQLLLLFSALCQWSLGFLWVQDTGWGRPGVVLEKAIFEQENRNVKFSLWA

SEQ ID NO: 797311 - protein, 79 aa, Homo sapiens
MSQRQLGQGGQSGPALRPPGGAGAVPDRSGPQGVAGSGDTERGSAEGLGWKVRVPHPASPAPAAAPPEGEGGQPEGGGR

SEQ ID NO: 797312 - protein, 95 aa, Homo sapiens
LRPRPLSSRALCTLAPPVSRASRRDPVHPLLEERPVSRSPSPSSISQKVSDAAVSRERQQVLIMVQGSLPASKSHPIHEKRWPRFPATSSTAPSL

SEQ ID NO: 797313 - protein, 177 aa, Homo sapiens
CRGEPSARDLTHCLDSVAVRELPLTGSGCSTEEPDGNAARPPAPVTHARRVGTAAGGVGSDTLLLAALRNSTGQRVLPRRRAAQVKEPSRVSEIQANSKQSVRDGWPGRATRPEVTPDDLRPLQAGWGLGLLRGPERCRVCPRGQGWDWSLPRRTGRTRGPGDRGAEGGDGARPPAG

SEQ ID NO: 797314 - protein, 332 aa, Homo sapiens
MTWTSGQLQREKQARPGSGAVLAFPDDMDLRVYGPAESQSAVFGDVCPLLTSLLDGYNVCVMAYGQTGSGKSYTMLGRHSDDGPVLPLDPQSDLGIIPRVAEELFRLILENTSRSPKVEVSIVEVYNNDIFDLLAKDSIAAVSGVKREVVTAKDGRTEVALLASEAVGSASKLMELVHGGLQLRAKHPTLVHADSSRSHLIITVTLTTASCSDSTADQACSATLPREQTEAGRAGRSRRASQGALAPQLVPGNPAGHAEQVQARLQLVDSAGSECVGGDAKLLVILCISPSQRHLAQTLQGLGFGIRARQVQRGPARKKPPSSQTEGKRRPD

SEQ ID NO: 797315 - protein, 384 aa, Homo sapiens
MTWTSGQLQREKQARPGSGAVLAFPDDMDLRVYGPAESQSAVFGDVCPLLTSLLDGYNVCVMAYGQTGSGKSYTMLGRHSDDGPVLPLDPQSDLGIIPRVAEELFRLILENTSRSPKVEVSIVEVYNNDIFDLLAKDSIAAVSGVKREVVTAKDGRTEVALLASEAVGSASKLMELVHGGLQLRAKHPTLVHADSSRSHLIITVTLTTASCSDSTADQACSATLPREQTEAGRAGRSRRASQGALAPQLVPGNPAGHAEQVQARLQLVDSAGSECVGVSGVTGLALREMACISRSLAALAGVLGALLEHRGHAPYRNSRLTHLLQDCLGGDAKLLVILCISPSQRHLAQTLQGLGFGIRARQVQRGPARKKPPSSQTEGKRRPD

SEQ ID NO: 797316 - protein, 90 aa, Homo sapiens
QEVSERWFRYNPRLTCIYCAKSFNQKGSLDRHMRLHMGITPFVCRMWARSIPGKISWSIISASTQATSPFTVMSVAKVSPSRLKHPGGGG

SEQ ID NO: 797317 - protein, 30 aa, Homo sapiens
MTVPPSQDHAPTAHTPFWFEAKSRAMGGAR

SEQ ID NO: 797318 - protein, 34 aa, Homo sapiens
MGADGDMAFWKTPWIWLNDTLTIMTTVDNHHANG

SEQ ID NO: 797319 - protein, 188 aa, Homo sapiens
GINTNFSLSSKKIGGNISQHILSSQHCPKISQENKTTGQYPLHPSPHSTRSTSGGLETKAGHVGPAVSLWPTPNQISGSRGSGELPWMSTLHRDSHTSSMGKHSLGCPHDPNGRGQPEAHTRVGLHLKNQKTKKKKNKKQNKNPKNQTNPNQPKANRRTPGPSIGGSCALPHTPLPRADFNLYSSTVI

SEQ ID NO: 797320 - protein, 51 aa, Homo sapiens
PLWASYPYTTNPGVGKTYTWWSLQVMGLSLTLHIPFWAQGKWFHGLRVWPF

SEQ ID NO: 797321 - protein, 117 aa, Homo sapiens
LRRDRLWSRSPSRPLTLSLGCSWRFRAVKAASAQGLFLSAPGPAARRCHGVVRCFSTCRALTARCTGRVPWEACLYSSEPPLTETVARSVSWTCELALTCYAPRALSGAPVLCRHDV

SEQ ID NO: 797322 - protein, 151 aa, Homo sapiens [sequence omitted]

SEQ ID NO: 797323 - protein, 147 aa, Homo sapiens
CSKVCPGPGLVLREERDHLVSTLLPDSSYQQPPSSAGRRAGTYNCPHMWGRQWKAPWIQSQETQCLPWLDLNPPCGQPQTPHIPSLGSFRSWEAVSAVGNQHQAWASDDYALTPSQFLADCVTPGQHLASLGLNLLLCEQQDRVWAP

SEQ ID NO: 797324 - protein, 128 aa, Homo sapiens
PSCTRKERCERSKEPRRFASEMKQCVRLTVHPNNISVSQYNVLLVLETYNVPELSAGVNCTFEDLSEMDGLVVGNQIQCYSPAAKEVPRIITENGDHHVVQLQLKSKETGMTFASTSFVFYNCSVHNS

SEQ ID NO: 797325 - protein, 72 aa, Homo sapiens
GTLIATPSPIYIFCAKDRAISFYQISLGYYVCLRNILCVCLIVIISQKLRKMFQHSEDLTSALRTAEFICAI

SEQ ID NO: 797326 - protein, 109 aa, Homo sapiens
WKSTGVFWERYSSLIRNRCREICTHYLSLAPAFLLWTSLCDDVLLLQLSCNHKEMAANNQGWQSEKMVRAWTYDDITKPLNYLVTDLLSLGPPTSRDFVKRDKSNVQIA

SEQ ID NO: 797327 - protein, 67 aa, Homo sapiens
QNFQITEPQSYGNLLPREKDSGISAFLICRNYKTDPIDMDIASSAKQHSRIFFPEGLDASCLVSSSD

SEQ ID NO: 797328 - protein, 78 aa, Homo sapiens [sequence omitted]

SEQ ID NO: 797329 - protein, 72 aa, Homo sapiens
DEEGGAQSRDCDLALGYVAAGHAELAWTQEAPVSSGPLLSPVPKLCRIKASKALKKKIRRFQPTALKVMTMV

SEQ ID NO: 797330 - protein, 88 aa, Homo sapiens
QPIHSFHKHQSTHCRPNVYSRSGMSPDRQDQAAESRKSPVTPAGDYASDGWLTLMAWSLRNGTPCFVAGCAHAHTSGPFSEHLHYFHF

SEQ ID NO: 797331 - protein, 115 aa, Homo sapiens
DSDKVPDEHFSMLLPTMEGMGEDWGWDREQEGVAQSVSAGRGRGAGKALQALCLGPLSTRTGLCTRGLKGQRRGPRFPTWHSLGRAPEAGDTLPYFVRVFLYALSSIWLCVHLAQ

SEQ ID NO: 797332 - protein, 84 aa, Homo sapiens
APVRPKTSPGSPKTVFPFSYQESPPRSPRRMSFSGIFRSSSKESSPNSNPATSPGGIRFFSRSRKKDLCWELFEIRMSLSEKFI

SEQ ID NO: 797333 - protein, 110 aa, Homo sapiens
LKEGLFPVITENNGSSLFARGSRPFLLPQHTWWIRHTVTGNSCSLLVMLNGGVGMMVDRLCLINMGSLETGKSPTVALFLPIPPLLHGELLCCRLRIFFKWMRSYIYPWK

SEQ ID NO: 797334 - protein, 109 aa, Homo sapiens
GALPRAGRGARRFGGRGSARHCGGPLDFHGTQVARLLGPEPVDPSGCHQRRRAASPGGSGGWARLRQSVRSEMAEQPRRGPWPRKQGSRAAPGRGGARGQRGRRPVLRV

SEQ ID NO: 797335 - protein, 109 aa, Homo sapiens; identical to SEQ ID NO: 797334

SEQ ID NO: 797336 - protein, 41 aa, Homo sapiens
GGRCQDNPQTSEQHGLPTKCGQRWGPGAMCSAKINRLCLKL

SEQ ID NO: 797337 - protein, 501 aa, Homo sapiens
FKMGEIGPRSSFSAPSRISAWFGPPASTPASTMSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKNTSGYAGGLSSAYGGLTSPGLSYSLGSSFGSGAGSSSLSRTSSSRAVVVKKIETC

SEQ ID NO: 797338 - protein, 302 aa, Homo sapiens
MQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKNTSGYAGGLSSAYGGLTSPGLSYSLGSSFGSGAGSSSLSRTSSSRAVVVKKIETC

SEQ ID NO: 797339 - protein, 485 aa, Homo sapiens
FKMGEIGPRSSFSAPSRISAWFGPPASTPASTMSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKNTSGYAGGLSSAYGGLTSPGLSYSLGSSFGSGAGSSSLSRTSSSRAVVVKKIETC

SEQ ID NO: 797340 - protein, 132 aa, Homo sapiens
MYHIFCIHSSVEGHLGSFQLLAIINKAAMNIVEHVSFLPVGASSGYMPRRGIAGSSGSTMSNFLRNRQTDFQSGCTSLQSHQQWRSVPLSPHPRQHLLSPEFLILDILTGVRWNLRVVLICISLMIKDVEHF

SEQ ID NO: 797341 - protein, 114 aa, Homo sapiens
LIPSYLSEIEMLLAIEIFMVSNASSIQSPGTSTQILQIVLKRCEDNQSRSNDDYQAAVERLIMAARISDPKLFVKHMTVNVNKEQVYSLEHCSALKWLKENMKWAGKVWLFSNH

SEQ ID NO: 797342 - protein, 147 aa, Homo sapiens
FFFETGSHSVTQAGVQWHDQGSLQPQPPRLKQSSCLSLSSSWDYSHVPPCLANLLIFFVETGSHFVVQAGLKHLGSNHPPTLASSSAGITGVNHCILPLFLKTITNTRLSPFSKCLTFGDPGCHCQLQVRVGTYGSQVIRGVSNRVY

SEQ ID NO: 797343 - protein, 127 aa, Homo sapiens [sequence omitted]

SEQ ID NO: 797344 - protein, 96 aa, Homo sapiens
RDTGCEREEMRSQHIQPPPPNTPGKRENPGGQPSGRVAHNKSTYILWDSGTSQTQDQGIQVLTFELSTALGGTCPSTSPNWKSGGTTSVHTCIPAR

SEQ ID NO: 797345 - protein, 151 aa, Homo sapiens
MPVIPAPWEAEAGGSRGQEFKTSLAKMVRPGSVALPYLIHEEERNRDVGTVCVCTGPVNLMVSEKLKGRESWRWKPREGGRWVGELETDGHMELHEAVGLCDQRINKKIWPEVQTEGKFIAAETDVGVVKSVALCEEDVKSSRPSSGALWY

SEQ ID NO: 797346 - protein, 143 aa, Homo sapiens
MVRIQRRKLLASCLCVTATVFLLVTLQVMVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGKQDFRLSPLFAVVFLQS

SEQ ID NO: 797347 - protein, 521 aa, Homo sapiens
MVRIQRRKLLASCLCVTATVFLLVTLQALDTVENLMKVTGPPQGVTDSMQCFNDQRPLSNTRSSEHIKEVMVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSDCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGEISNQRLLTALRERKWGVQDVNQDNYIDAFECMVCTKVWANIRLQEKGLPPKRWEAEDTHLSCPEPTVFAFSPLRTPPLSSLREMWISSFEQSKKEAQALRWLVDRNQNFSSQEFWGLVFKD

SEQ ID NO: 797348 - protein, 355 aa, Homo sapiens
MGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSDCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGEISNQRLLTALRERKWGVQDVNQDNYIDAFECMVCTKVWANIRLQEKGLPPKRWEAEDTHLSCPEPTVFAFSPLRTPPLSSLREMWISSFEQSKKEAQALRWLVDRNQNFSSQEFWGLVFKD

SEQ ID NO: 797349 - protein, 521 aa, Homo sapiens; identical to SEQ ID NO: 797347

SEQ ID NO: 797350 - protein, 523 aa, Homo sapiens
MVRIQRRKLLASCLCVTATVFLLVTLQALDTVENLMKVTGPPQGVTDSMQCFNDQRPLSNTRSSEHIKEVMVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSDCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGEISNQRLLTALRERKWGVQDVNQDNYIDAFECMVCTKVWANIRLQEKGLPPKRWEAEDTHLSCPEPTVFAFSPLRTPPLSSLREMWISSFEQSKKEAQALSLLVFGKPGILQPSMNMKYIRTWQ

SEQ ID NO: 797351 - protein, 355 aa, Homo sapiens; identical to SEQ ID NO: 797348

SEQ ID NO: 797352 - protein, 491 aa, Homo sapiens
MVRIQRRKLLASCLCVTATVFLLVTLQVMVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGPRRITTFGENDGTDFNIDSLPLPRKAHHDWAVFHEESPKNNYKLFHKPVITLFNYTATFSRHSHLPLTTQYLESIEVLKSLRYLVPLQSKNKLRKRLAPLVYVQSDCDPPSDRDSYVRELMTYIEVDSYGECLRNKDLPQQLKNPASMDADGFYRIIAQYKFILAFENAVCDDYITEKFWRPLKLGVVPVYYGSPSITDWLPSNKSAILVSEFSHPRELASYIRRLDSDDRLYEAYVEWKLKGEISNQRLLTALRERKWGVQDVNQDNYIDAFECMVCTKVWANIRLQEKGLPPKRWEAEDTHLSCPEPTVFAFSPLRTPPLSSLREMWISSFEQSKKEAQALRWLVDRNQNFSSQEFWGLVFKD

SEQ ID NO: 797353 - protein, 185 aa, Homo sapiens
MVRIQRRKLLASCLCVTATVFLLVTLQALDTVENLMKVTGPPQGVTDSMQCFNDQRPLSNTRSSEHIKEVMVELGKFERKEFKSSSLQDGHTKMEEAPTHLNSFLKKEGLTFNRKRKWELDSYPIMLWWSPLTGETGRLGQCGADACFFTINRTYLHHHMTKAFLFYGKQDFRLSPLFAVVFLQS

SEQ ID NO: 797354 - protein, 77 aa, Homo sapiens
AGPPDPGTMGWGGLSLGGRSGFLGPPHALGQSSFTGGPERQLTDSCPGPSCATEPPDLGASEPRAQEMNQDLSEGTK

SEQ ID NO: 797355 - protein, 92 aa, Homo sapiens
AGPPDPGTMGWGGLSLGGRSGFLGPPHALGQSSFTGGPERQLTDSCPGPSCATEPPDLGASEPRAQESGRGSHQAFPSDPLQMNQDLSEGTK

SEQ ID NO: 797356 - protein, 126 aa, Homo sapiens
VLKHLFTSHSTGIGRKGCQLTTEDLEAYIYVFSQPGALSGPINHYRNIFSCLPLKHHMVTTPTLLLWGENDAFMEVEMAEVTKIYVKNYFRLTILSEASHWLQQDQPDIVNKLIWTFLKEETRKKD

SEQ ID NO: 797357 - protein, 91 aa, Homo sapiens
IAGPAEPTPTGNSRWPASAERSPGSRLRLSLHTSLQAEGAGSGLGQPRKGLLQCSCGLRGSSSAARVGAKAEEAPRASQGCEGCQQAVTSQ

SEQ ID NO: 797358 - protein, 79 aa, Homo sapiens
ALPAFGQAAQHVRFVRQWSVFGKTLCRALPELLGVTLGLVVLGVAYAQLAILVGAVWPTRTQGPLPSSLGKDTAVLDGF

SEQ ID NO: 797359 - protein, 90 aa, Homo sapiens
ALPAFGQAAQHVRFVRQWSVFGKTLCRALPELLGVTLGLVVLGVAYAQLAILVGLVSSCVDSLWSVAQALLVLCPGTGLSTLCPAESWDL

SEQ ID NO: 797360 - protein, 113 aa, Homo sapiens
TLGGEVCGCATLQRDLCLSSTPTPAMLMFIGFGHLCIPIVVTVSYEWSKSCSEVQIMMEQAALEMSGQCRINETKRLHLPHLTPSIPASFTVCHQPHVKGIPTSSFTTYYYTM

SEQ ID NO: 797361 - protein, 115 aa, Homo sapiens
GGRGLCLPPFPTRLPWRAGNGTKHPWDRLAPAQKVRMSLKLSLRRLNPSLSCRGHCGDPAVHTSGDPSTQASFSLFRGADTLGLSSGVSHHLEERWARRKLPSAAAVAGLPVPSL

SEQ ID NO: 797362 - protein, 182 aa, Homo sapiens
MGENEASLPNTSLQGKKMAYQKVHADQRAPGHSQYLDNDDLQATALDLEWDMEKELEESGFDQFQLDGAENQNLGHSETIDLNLDSIQPATSPKGRFQRLQEESDYITHYTRSAPKSNRCNFCHVLKILCTATILFIFGILIGYYVHTNCPSDAPSSGTVDPQLYQEILKTIQAEDIKKSFR

SEQ ID NO: 797363 - protein, 118 aa, Homo sapiens
GWEIIQQKACHVLVTGAHFSGQKIFPTASVLLVNVCVCVGCRRKPGKTSWVLDEKMGDFVIGWSKENHKKAQWHLTPNGKPKMTLPLGYSFVLEEQGEKKKDRGKLYQTCPSPARISN

SEQ ID NO: 797364 - protein, 242 aa, Homo sapiens
MFLLLLGGAWAACGSLDLLTKLYAENLPCVHLNPQWPSQPSHCPRGWRSNPLPPAAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQ

SEQ ID NO: 797365 - protein, 56 aa, Homo sapiens
HTPSAPSTAPTRTLVTASTCGCDHSPSAPPQVAATPSLLHSQLHHRDPAGACHVVS

SEQ ID NO: 797366 - protein, 80 aa, Homo sapiens
NPGCAQDSLSTHHEELQVAATLCSASHSGCDILSVYLHSVETLETAHVNHDSAVFPYHENSRAMGFSIFRVNALAINVIP

SEQ ID NO: 797367 - protein, 111 aa, Homo sapiens
MLRTTPEGLAISPMFQMRKWRLGEVMCPGTQLGLGTQSQLGPKLDRDTPPLPGPLPCLSCPELRFLWRATGWAEGELSSAKTALAYFTANPRPIRSLLINKSAVFLRTFKT

SEQ ID NO: 797368 - protein, 127 aa, Homo sapiens
QLSIHRRSHTGDRPFQCDLCRKRFLQPSDLRVHQRVHTGERPYMCDVCQKRFAHESTLQGHKRIHTGERPFKCKYCSKVFSHKGNLNVHQRTHSGEKPYKCPTCQKAFRQLGTFKRHLKTHRETTSQ

SEQ ID NO: 797369 - protein, 35 aa, Homo sapiens
MSKVDSSWYTWLREKTVRVFFLAAPACRSAPPSRG

SEQ ID NO: 797370 - protein, 147 aa, Homo sapiens
LSLKNKPQLSPLLTTSLSCYFPQGFPLPRLSQAAVPYLRTPGWLPSAASWGLAETTTPAHGLSALIGLAPASLHHSGGLPLSITVVAFQEARHGHKHLSLHMVAAKANHRPAQLQARDEDKPPTRPAPNAKPCCDPCVQCAVTAPQG

SEQ ID NO: 797371 - protein, 108 aa, Homo sapiens
VSRNFHSFFPPRTWKRSKGRDRSSQSCLQERPETRFTELGRGARDPGQEGLADAQKVRRKQLQFPECARLPGASERLQVWPPCLKHPHPPAGLATSQSALSSYLFLPH

SEQ ID NO: 797372 - protein, 98 aa, Homo sapiens
QADNASLSTNGLGSSPGSAGHMNGLSHSPGNPSTIPMKDHDAIKLFIGQIPRNLDEKDLKPLFEEFGKIYELTVLKDRFTGMHKDARRLVLSSSSFYR

SEQ ID NO: 797373 - protein, 87 aa, Homo sapiens
YRTLELQQNCSSLGLQLHDLHTRTRPLLPGSPASGPSNYNNIAPPWFGSSTTLKLEQDLSSLGLQLPDPRITTKLLLHGSAAPRPSN

SEQ ID NO: 797374 - protein, 103 aa, Homo sapiens
TPECQYPPGPLPPHHTHRQMHKQTHWLQAGSTFMAKHGSALGAQESRALTKATGGTQEEGQADNMETPRAECAFSSLARGGKWRFGERGLLSPDEGVRSGREE

SEQ ID NO: 797375 - protein, 78 aa, Homo sapiens
FMEDPSLPSAGSTLELCKAPTYHCLPNPGDQTFPTHPISCPTICRELLTFNLPHSMRVSHILGTQIKLSGSLLEASLT

SEQ ID NO: 797376 - protein, 272 aa, Homo sapiens
PTQLGAPLLSSPSPVCLPPAAPTMTTTIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQGLRLSVEADINGLRQGAGEEWPWQKRDREMRNGRTQGEPATEENPGGDETLKPGGGDTAGWPPQGGGANQIG

SEQ ID NO: 797377 - protein, 177 aa, Homo sapiens
QTLLSGSQWDAMERSLHRVSLGSRRAHPDLSFYLTTFGQLRLSIDAQDRVLLLHIIEGKGLISKQPGTCDPYVKISLIPEDSRLRHQKTQTVPDCRDPAFHEHFFFPVQEEDDQKRLLVTVWNRASQSRQSGLIGCMSFGVKSLLTPDKEISGWYYLLGEHLGRTKHLKVARRRLRP

SEQ ID NO: 797378 - protein, 162 aa, Homo sapiens
TPDVVGGAEPCGFLRSLPARDLCQLRLSIDAQDRVLLLHIIEGKGLISKQPGTCDPYVKISLIPEDSRLRHQKTQTVPDCRDPAFHEHFFFPVQEEDDQKRLLVTVWNRASQSRQSGLIGCMSFGVKSLLTPDKEISGWYYLLGEHLGRTKHLKVARRRLRP

SEQ ID NO: 797379 - protein, 128 aa, Homo sapiens
LKVLKIAASLGPSYSGSLLLFDALRGHFCCIRLRSCRLDCAACGKWPTVTHLLDYEAFCGSSATDKCRSLQLLGPEDRVSVTDYKRLLDSGAPHLLLDIRPKMEVMKRRWLSANLGAGSNQTLHLPVP

SEQ ID NO: 797380 - protein, 120 aa, Homo sapiens
PLKSQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYGMLFKNYCIYGLVISCH

SEQ ID NO: 797381 - protein, 94 aa, Homo sapiens
APRTPTTTCLDSACLCCSNPHLPQHPKTDTSGPAWVGDIYWQSSCTSLTLEGSFGLRLKPRTEQKEMELRKWDHPVSILGFWAFLSINSPKEET

SEQ ID NO: 797382 - protein, 116 aa, Homo sapiens
MVSVGGTGSGSVSIADSRNTSSVTFGLASSGGSRSDSLCVSSIGASKSLKNSPISLDVSDFTSWCIPGSVSLGTSLLDSLAIPSWDVPPGFSCTFLALSGSPSLKSSSSVSGCGSW

SEQ ID NO: 797383 - protein, 106 aa, Homo sapiens
GIFLLNPLQASGRFPRACLYLAAEEVEGQRGGSHAPEAVWLLRRPEESLRRPGSSSCVSAQSLQNFVSVATGSENLFWPGRLEPGLVVGRRPAQCSSQPCQTERGN

SEQ ID NO: 797384 - protein, 91 aa, Homo sapiens
WMPAIAAAPKVEATRTGWMRMAQRLWSCWPQSKSDTMGSLHESCPWIDNLNHTSSSMDPGQHTKSRQVKTEEISPGLQLPPERSLLLMAEA

SEQ ID NO: 797385 - protein, 595 aa, Homo sapiens
MTSPLCRAASANALPPQDQASTPSSRVKGREASGKPSHLRGKGTAQAWTPGRSKGGSFHRGAGKPSVHSQVAELHKKIQLLEGDRKAFFESSQWNIKKNQETISQLRKETKALELKLLDLLKGDEKVVQAVIREWKWEKPYLKNRTGQALEHLDHRLREKVKQQNALRHQVVLRQRRLEELQLQHSLRLLEMAEAQNRHTEVAKTMRNLENRLEKAQMKAQEAEHITSVYLQLKAYLMDESLNLENRLDSMEAEVVRTKHELEALHVVNQEALNARDIAKNQLQYLEETLVRERKKRERYISECKKRAEEKKLENERMERKTHREHLLLQSDDTIQDSLHAKEEELRQRWSMYQMEVIFGKVKDATGTDETHSLVRRFLAQGDTFAQLETLKSENEQTLVRLKQEKQQLQRELEDLKYSGEATLVSQQKLQAEAQERLKKEERRHAEAKDQLERALRAMQVAKDSLEHLASKLIHITVEDGRFAGKELDPQADNYVPNLLGLVEEKLLKLQAQLQGHDVQEMLCHIANREFLASLEGRLPEYNTRIALPLATSKDKFFDEESEEEDNEVVTRASLKIRSQKLIESHKKHRRSRRS

SEQ ID NO: 797386 - protein, 543 aa, Homo sapiens
MANKGLSSGDVAPMHPPSNCVSVHLTCLPEGDRKAFFESSQWNIKKNQETISQLRKETKALELKLLDLLKGDEKVVQAVIREWKWEKPYLKNRTGQALEHLDHRLREKVKQQNALRHQVVLRQRRLEELQLQHSLRLLEMAEAQNRHTEVAKTMRNLENRLEKAQMKAQEAEHITSVYLQLKAYLMDESLNLENRLDSMEAEVVRTKHELEALHVVNQEALNARDIAKNQLQYLEETLVRERKKRERYISECKKRAEEKKLENERMERKTHREHLLLQSDDTIQDSLHAKEEELRQRWSMYQMEVIFGKVKDATGTDETHSLVRRFLAQGDTFAQLETLKSENEQTLVRLKQEKQQLQRELEDLKYSGEATLVSQQKLQAEAQERLKKEERRHAEAKDQLERALRAMQVAKDSLEHLASKLIHITVEDGRFAGKELDPQADNYVPNLLGLVEEKLLKLQAQLQGHDVQEMLCHIANREFLASLEGRLPEYNTRIALPLATSKDKFFDEESEEEDNEVVTRASLKIRSQKLIESHKKHRRSRRS

SEQ ID NO: 797387 - protein, 180 aa, Homo sapiens
MTSPLCRAASANALPPQDQASTPSSRVKGREASGKPSHLRGKGTAQAWTPGRSKGGSFHRGAGKPSVHSQVAELHKKIQLLEGDRKAFFESSQWNIKKNQETISQLRKETKALELKLLDLLKGDEKVVQAVIREWKWEKPYLKNRTGQVCPPSPHLLLHFQPGSPHHWTPGSPSPILPAH

SEQ ID NO: 797388 - protein, 276 aa, Homo sapiens
VISQQNRFIICIACRIKPILESSESWAVSSVVSEGQGTGHCSHHLLPGSLHLRGEFFAEMDCQNGHQHISQELEVLRIHMQLVTVQFTQLGKGALEIIQVLCGISQGSQHLLAMCLDFGVAHDGRGRGQVAKAVKEPLGPWVDNQEPSQGFSSSIFHIHLAPQACDSSLVLLCEMTHGVWTRSLLITSDVPEASVTQILLCAMWTLPSHATNKGAHSVGLMWWMLAREVLRMRGTISREHPWEVMPDLYFYRDPEEIEKEEQAAAEKGSDQGGISG

SEQ ID NO: 797389 - protein, 81 aa, Homo sapiens
FTATQPEVADWSEGVQVPSVPIQQFPTEDWSAQPATEDWSAAPTAQATEWVGATTDWVLRGYGNLLSGSTNAALFWIPVVT

SEQ ID NO: 797390 - protein, 116 aa, Homo sapiens
MPCPPSCWPCPVLAHGRSCLICTSTEILKRLKKKSRLLLRKAVTKEEFQGEWTAPAPEFTATQPEVADWSEGVQVPSVPIQQFPTEDWSAQPATEDWSAAPTAQATEWVGATTDWS

SEQ ID NO: 797391 - protein, 83 aa, Homo sapiens
MSGALDVLQMKEEDVLKFLAAGTHLGGTNLDFQMEQYIYKRKSDGIYIINLKRTWEKLLLASSCRFTLLVRDIRTSGVSLDSL

SEQ ID NO: 797392 - protein, 72 aa, Homo sapiens
MSGALDVLQMKEEDVLKFLAAGTHLGGTNLDFQMEQYIYKRKSDGIAYLYHISKEALERGFSCTAAHIFHIK

SEQ ID NO: 797393 - protein, 92 aa, Homo sapiens
SILIKSSSNRPYMSYHLRELNSAIRRNNLEPHSTHVQWWMLAREVLRMRGTISREHPWEVMPDLYFYRDPEEIEKEEQAAAEKGSDQGGISG

SEQ ID NO: 797394 - protein, 118 aa, Homo sapiens
LPPFLWFINPPFNVCMCRFETVYLNTTMCKDVWKCCAMFSINSRAEFMNPPLLMYQTLSMPYLYPQMSVASFKVATLGSGGIIPQMQAWVGLPRIFIFHLIGLRWATKLCSTFWTSIF

SEQ ID NO: 797395 - protein, 105 aa, Homo sapiens
APVVAEATMLPKHQIKVAKACESCQYQNGVTYVKTLTKWSQEALKKFSPHMPIIYLITRNSCRSHMPHFCTHPATELITGIFQACSISDKLPAPGQLLSNSHLHQ

SEQ ID NO: 797396 - protein, 346 aa, Homo sapiens
MGEFMAMEAGLSEVKSELQSRDDLLRIIEMERLQLHRELLKIGECQNAQGNKTRLESSYLPSIKEPERKIKELFSVMQDQPNHEKELNKIRSQLQQVEEYHNSEQERMRNEISDLTEELHQKEITIATVTKKAALLEKQLKMELEIKEKMLAKQKVSDMKYKAVRTENTHLKGMMGDLDPGEYMSMDFTNREQSRHTSINKLQYENERLRNDLAKLHVNGKSTWTNQNTYEETGRYAYQSQIKVEQNEERLSHDCEPNRSTMPPLPPSTFQAKEMTSPLVSDDDVFPLSPPDMSFPASLAAQHFLLEEEKRAKELEKLLNTHIDELQRHTEFTLNKYSKLKQNRHI

SEQ ID NO: 797397 - protein, 147 aa, Homo sapiens
MLFYTMKPSETSFQTLEEVPDYVKKATPFFISLMLLELVVSWILKGKPPGRLDDALTSISAGVLSRLPSLFFRSIELTSYIYIWENYRLFNLPWDSPWTWYSAFLGVDFGYYWFHRMAHEFPTLPWPSSYPLQYMLFIFNSIFFTNL

SEQ ID NO: 797398 - protein, 36 aa, Homo sapiens
RCHPDRVIDATLVARSPGRGWEHSNATHNRLSGPAP

SEQ ID NO: 797399 - protein, 30 aa, Homo sapiens
MYRLQVPRREGGIRHATQVTAKTLTWEPDW

SEQ ID NO: 797400 - protein, 79 aa, Homo sapiens
MLAPPSKCTQDGTASPYSHVSHPAPGHLQLALKDHGRIQLVSLLLPSPLQSISLLCSPLGSGHCSQAQEKPKSWPGAVA

SEQ ID NO: 797401 - protein, 90 aa, Homo sapiens [sequence omitted]

SEQ ID NO: 797402 - protein, 40 aa, Homo sapiens
SSCPRTSSPGPKLPQVSLSSPNCCLLVAYEGPKSPQVDLS

SEQ ID NO: 797403 - protein, 208 aa, Homo sapiens
SGAFLPLKKGPKEPIPEEQELDFQGLEEEEEPSEGLEEEGPEAGGKELTPLPPQEEKSSSPSPLPTLGPLWGTNGDGDETAEKEPPAAEDDIRGIQLSPGVGSSAGPPGDLEDDEGLKHLQQEAEKLVASLQDSSLEEEQFTAAMQTQGLRHSAAATALPLSHGAARKWFYKDPQGEIQGPFTTQEMAEWFQAGYFSMSLLVKRGCDE

SEQ ID NO: 797404 - protein, 122 aa, Homo sapiens
CVQCSVVSSHARAWGVNQKDPNAGRAQRPRAPSADYQTPLPEKGPSSPLIAQLRTLSGAITVLPTHVSRRAQWEGVCSLLLLWAKTPRSETPTRPSHYPETAPPAQLRAGPLTLWLSGHICY

SEQ ID NO: 797405 - protein, 90 aa, Homo sapiens
MCQLKAIFLGSAHVSLSECHKCILFYIYLKTAKKLGEMEMPAQIVKIEMDTDQKCWWLYKGCFLKNLKRGEGRTWLGKQMTVYSTSLCGL

SEQ ID NO: 797406 - protein, 73 aa, Homo sapiens
MAHNTIPQPVKGLPSSGSNLPLQHNWVSSPIWNLLQAYRYSPNLQAHQKFLPNLIMFVLDPLAQWLPNITRAG

SEQ ID NO: 797407 - protein, 151 aa, Homo sapiens
NSATDSSLTFSLGPSTACARGVPWNAVVMQVVKDHISRRHDEEVGAAVLRAGSGEGSRRGLQLTPPPRRVHGALQRFGGGRNLKSNWMSTTRTPRRSGASGPKMVADQTSGISRPPTAGIGTSRLCLGDRQVVPLWFFRRCLPGGILTLSL

SEQ ID NO: 797408 - protein, 107 aa, Homo sapiens
MGVYVIHSSYIDGVSLLLPKLDCSGASLAHCKLCLPVSSDSPASASGVAGTTGTHHAQRKTDLQQFFDGNKQFQVETTHQLHAFLQLEVNWAWVESGSVLLLFHFVF

SEQ ID NO: 797409 - protein, 80 aa, Homo sapiens
MQLSSFLRVLAAVWVAFAKMTGIGHASSLRRASTMVPAWVSQRAPMAKTQRLQLCGSLLLMIMIKLFDAINIQHSGFVIK

SEQ ID NO: 797410 - protein, 211 aa, Homo sapiens
GNQLLRLKKVDTATLRSELSRIDSQWTDLLTNIPAVQEKLHQLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDLIKA

SEQ ID NO: 797411 - protein, 214 aa, Homo sapiens
MFNFKLSERLQMDKLPSRHAISEVMSWISLMENVIQKDEDNIKNSIGYKAIHEYLQKYKGFKIDINCKQLTVDFVNQSVLQISSQDVESKRSDKTDFAEQLGAMNKSWQILQGLVTEKIQLLEGLLESWSEYENNVQCLKTWFETQEKRLKQQHRIGDQASVQNALKDCQDLEDFDYSKKKTQQQIKKIFWARLGPSKKFLNHFFVGAGPPLVC

SEQ ID NO: 797412 - protein, 62 aa, Homo sapiens
MISQGSLPGQGPNTIAKGLIVNQTSKGPRQQRAWKEMVQIKVGEGSKIRKFKNTSYGIMLTP

SEQ ID NO: 797413 - protein, 113 aa, Homo sapiens
MLWLRFSATCSEPSILSPFLSTGSQKIRVEHQGFSTVSSSSPACCDRRFLMPVALWNEGHGQYYPHSHSKSVGFVTCCERMAIAVPARDMDSDACAHRCTFQKVRSARAPTAM

SEQ ID NO: 797414 - protein, 67 aa, Homo sapiens
HAHGWPSPTRSSLGSPSSRLLAASEPSLSQPTAPAPVDFHHLTCRHASRSSEATALADDTLEAHTPP

SEQ ID NO: 797415 - protein, 1516 aa, Homo sapiens [sequence omitted]

SEQ ID NO: 797416 - protein, 372 aa, Homo sapiens [sequence omitted]

SEQ ID NO: 797417 - protein, 372 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDAIKLMKDISQNFPIKARSLTRIAVNQHMREEIKENQKYIPEFLPR

SEQ ID NO: 797418 - protein, 35 aa, Homo sapiens
PTTSNAPPRSTACPSFELALCDEGTPSKWPRPMGI

SEQ ID NO: 797419 - protein, 111 aa, Homo sapiens
AADPEAAAGRPAGLDRCLRVRGEPHTFRGAGATPAEPCHRLEAPGPAGPLPAPQSGRLPALLGQRPSGPSKEARRPALPRMPSGRASPLHMAPLCTILARSCREGWRWGLS

SEQ ID NO: 797420 - protein, 262 aa, Homo sapiens
MVGYCAARSEGLLPSFHTISPTLFNASSNDMKLKPELFLTQQFLSGHLPKYEQVHILPVGRIEEPFWQNFKHLQEEVFQKIKTLAQLSKDVQDVMFYSILAMLRDRGALQDLMNMLELDSSGHLDGPGGAILKKLQQDSNHAWFNPKDPILYLLEAIMVLSDFQHDLLACSMEKRILLQQQELVRSILEPNFRYPWSIPFTLKPELLAPLQSEGLAITYGLLEECGLRMELDNPRSTWDVEAKMPLSALYGTLSLLQQLAEA

SEQ ID NO: 797421 - protein, 508 aa, Homo sapiens
MPSMLERISKNLVKEIGSKDLTPVKYLLSATKLRQFVILRKKKDSRSSFWEQSDYVPVEFSLNDILEPSSSVLETVVTGPFHFSDIMIQKHKADMGVNVGIEVSVSGEASVDHGCSLEFQIVTIPSPNLEDFQKRKLLDPEPSFLKECRRRGDNLYVVTEAVELINNTVLYDSSSVNILGKIALWITYGKGQGQGESLRVKKKALTLQKGMVMAYKRKQLVIKEKAILISDDDEQRTFQDEYEISEMVGYCAARSEGLLPSFHTISPTLFNASSNDMKLKPELFLTQQFLSGHLPKYEQVHILPVGRIEEPFWQNFKHLQEEVFQKIKTLAQLSKDVQDVMFYSILAMLRDRGALQDLMNMLELDSSGHLDGPGGAILKKLQQDSNHAWFNPKDPILYLLEAIMVLSDFQHDLLACSMEKRILLQQQELVRSILEPNFRYPWSIPFTLKPELLAPLQSEGLAITYGLLEECGLRMELDNPRSTWDVEAKMPLSALYGTLSLLQQLAEA

SEQ ID NO: 797422 - protein, 408 aa, Homo sapiens
MWAFSELPMPLLINLIVSLLGFVATVTLIPAFRGHFIAARLCGQDLNKTSRQQIPESQGVISGAVFLIILFCFIPFPFLNCFVKEQCKAFPHHEFVALIGALLAICCMIFLGFADDVLNLRWRHKLLLPTAASLPLLMVYFTNFGNTTIVVPKPFRPILGLHLDLGILYYVYMGLLAVFCTNAINILAGINGLEAGQSLVISASIIVFNLVELEGDCRDDHVFSLYFMIPFFFTTLGLLYHNWYPSRVFVGDTFCYFAGMTFAVVGILGHFSKTMLLFFMPQVFNFLYSLPQLLHIIPCPRHRIPRLNIKTGKLEMSYSKFKTKSLSFLGTFILKVAESLQLVTVHQSETEDGEFTECNNMTLINLLLKVLGPIHERNLTLLLLLLQILGSAITFSIRYQLVRLFYDV

SEQ ID NO: 797423 - protein, 408 aa, Homo sapiens; identical to SEQ ID NO: 797422

SEQ ID NO: 797424 - protein, 408 aa, Homo sapiens; identical to SEQ ID NO: 797422

SEQ ID NO: 797425 - protein, 408 aa, Homo sapiens; identical to SEQ ID NO: 797422

SEQ ID NO: 797426 - protein, 408 aa, Homo sapiens; identical to SEQ ID NO: 797422

SEQ ID NO: 797427 - protein, 264 aa, Homo sapiens
IPYSFTITKPFRPILGLHLDLGILYYVYMGLLAVFCTNAINILAGINGLEAGQSLVISASIIVFNLVELEGDCRDDHVFSLYFMIPFFFTTLGLLYHNWYPSRVFVGDTFCYFAGMTFAVVGILGHFSKTMLLFFMPQVFNFLYSLPQLLHIIPCPRHRIPRLNIKTGKLEMSYSKFKTKSLSFLGTFILKVAESLQLVTVHQSETEDGEFTECNNMTLINLLLKVLGPIHERNLTLLLLLLQILGSAITFSIRYQLVRLFYDV

SEQ ID NO: 797428 - protein, 149 aa, Homo sapiens [sequence omitted]

SEQ ID NO: 797429 - protein, 408 aa, Homo sapiens; identical to SEQ ID NO: 797422

SEQ ID NO: 797430 - protein, 408 aa, Homo sapiens; identical to SEQ ID NO: 797422

SEQ ID NO: 797431 - protein, 416 aa, Homo sapiens
MWAFSELPMPLLINLIVSLLGFVATVTLIPAFRGHFIAARLCGQDLNKTSRQQIPESQGVISGAVFLIILFCFIPFPFLNCFVKEQCKAFPHHEFVALIGALLAICCMIFLGFADDVLNLRWRHKLLLPTAASLPLLMVYFTNFGNTTIVVPKPFRPILGLHLDLGILYYVYMGLLAVFCTNAINILAGINGLEAGQSLVISASIIVFNLVELEGDCRDDHVFSLYFMIPFFFTTLGLLYHNWYPSRVFVGDTFCYFAGMTFAVVGILGHFSKTMLLFFMPQVFNFLYSLPQLLHIIPCPRHRIPRLNIKTGKLEMSYSKFKTKSLSFLGTFILKVAESLQLVTVHQSETEDGEFTECNNMTLINLLLKVLGPIHERNLTLLLLLLQNLGSAVTITKRYQHDHNKDDRDPRTMTKT

SEQ ID NO: 797432 - protein, 338 aa, Homo sapiens
MWAFSELPMPLLINLIVSLLGFVATVTLIPAFRGHFIAARLCGQDLNKTSRQQIPESQGVISGAVFLIILFCFIPFPFLNCFVKEQCKAFPHHEFVALIGALLAICCMIFLGFADDVLNLRWRHKLLLPTAASLPLLMVYFTNFGNTTIVVPKPFRPILGLHLDLGILYYVYMGLLAVFCTNAINILAGINGLEAGQSLVISASIIVFNLVELEGDCRDDHVFSLYFMIPFFFTTLGLLYHNWYPSRVFVGDTFCYFAGMTFAVVGILGHFSKTMLLFFMPQVFNFLYSLPQLLHIIPCPRHRIPRLNIKTGKLEMSYSKFKTKSLSFLGTFILKVTG

SEQ ID NO: 797433 - protein, 153 aa, Homo sapiens
MWAFSELPMPLLINLIVSLLGFVATVTLIPAFRGHFIAARLCGQDLNKTSRQQIPESQGVISGAVFLIILFCFIPFPFLNCFVKEQCKAFPHHEFVALIGALLAICCMIFLGFADDVLNLRWRHKLLLPTAASLPLLMVYFTNFGPAYFGDPL

SEQ ID NO: 797434 - protein, 224 aa, Homo sapiens
MWAFSELPMPLLINLIVSLLGFVATVTLIPAFRGHFIAARLCGQDLNKTSRQQIPESQGVISGAVFLIILFCFIPFPFLNCFVKEQCKAFPHHEFVALIGALLAICCMIFLGFADDVLNLRWRHKLLLPTAASLPLLMVYFTNFGNTTIVVPKPFRPILGLHLDLGILYYVYMGLLAVFCTNAINILAGINGLEAGQSLVISASIIVFNLVELEGVRETGFPYQ

SEQ ID NO: 797435 - protein, 301 aa, Homo sapiens
MIFLGFADDVLNLRWRHKLLLPTAASLPLLMVYFTNFGNTTIVVPKPFRPILGLHLDLGILYYVYMGLLAVFCTNAINILAGINGLEAGQSLVISASIIVFNLVELEGDCRDDHVFSLYFMIPFFFTTLGLLYHNWYPSRVFVGDTFCYFAGMTFAVVGILGHFSKTMLLFFMPQVFNFLYSLPQLLHIIPCPRHRIPRLNIKTGKLEMSYSKFKTKSLSFLGTFILKVAESLQLVTVHQSETEDGEFTECNNMTLINLLLKVLGPIHERNLTLLLLLLQILGSAITFSIRYQLVRLFYDV

SEQ ID NO: 797436 - protein, 93 aa, Homo sapiens
TAPRTFPLPLDVHPGPVWFQNRRAKSRRQSGKSFQPLARPEIILNHCAPGTETKCLKPQLPLETLVQSWTHGRNTSFLPLVTFEDSGRIRDKL

SEQ ID NO: 797437 - protein, 232 aa, Homo sapiens
MATAESRALQFAEGAAFPAYRAPHAGGALLPPPSPAAALLPAPPAGPGPATFAGFLGRDPGPAPPPPASLGSPAPPKGAAAPSASQRRKRTSFSAEQLQLLELVFRRTRYPDIHLRERLAALTLLPESRIQVWFQNRRAKSRRQSGKSFQPLARPEIILNHCAPGTETKCLKPQLPLEVDVNCLPEPNGVGGGISDSSSQGQNFETCSPLSEDIGSKLDSWEEHIFSAFGNF

SEQ ID NO: 797438 - protein, 147 aa, Homo sapiens
GWYWSGILGSEQLQLLELVFRRTRYPDIHLRERLAALTLLPESRIQVWFQNRRAKSRRQSGKSFQPLARPEIILNHCAPGTETKCLKPQLPLEVDVNCLPEPNGVGGGISDSSSQGQNFETCSPLSEDIGSKLDSWEEHIFSAFGNF

SEQ ID NO: 797439 - protein, 163 aa, Homo sapiens
FQKRYVAYFAQVKHLYNWNLPPRRILFIKHFIIYSIPRYVRDLKIQIEMEKKVVFSTISLGKCSVLDNITTDKILIDVFDGPPLYDDVKVQFFYSNLPTYYDNCSFYFWLHTSFIENNRLYLPKNELDNLHKQKARRIYPSDFAVEILFGEKMTSSDVVAGSD

SEQ ID NO: 797440 - protein, 132 aa, Homo sapiens
FQKRYVAYFAQVKHLYNWNLPPRRILFIKHFIIYSIPRYVRDLKIQIEMEKKVVFSTISLGKCSNLPTYYDNCSFYFWLHTSFIENNRLYLPKNELDNLHKQKARRIYPSDFAVEILFGEKMTSSDVVAGSD

SEQ ID NO: 797441 - protein, 58 aa, Homo sapiens
MIFLGFADDVLNLRWRHKLLLPTAASLPLLMVYFTNLGNTTIVVPKPFRPILGLHLDL

SEQ ID NO: 797442 - protein, 165 aa, Homo sapiens
MWAFSELPMPLLINLIVSLLGFVATVTLIPAFRGHFIAARLCGQDLNKTSRQQIPESQGVISGAVFLIILFCFIPFPFLNCFVKEQCKAFPHHEFVALIGALLAICCMIFLGFADDVLNLRWRHKLLLPTAASLPLLMVYFTNLGNTTIVVPKPFRPILGLHLDL

SEQ ID NO: 797443 - protein, 58 aa, Homo sapiens; identical to SEQ ID NO: 797441

SEQ ID NO: 797444 - protein, 53 aa, Homo sapiens
PEGSEGTQEGDEGTPEGDEGAPEGSEGTPQSNEWTPQGSKGTPDGGEGTPGGS

SEQ ID NO: 797445 - protein, 83 aa, Homo sapiens
PKRCLSLGRGASSLEAAEHLSCCPQADGLSRSPQWASAPPRQLLSCPSAGPRGPLQLARSPGSRRGPWVPPQGPPHQHSALTI

SEQ ID NO: 797446 - protein, 68 aa, Homo sapiens
TLPLIILCLLEMTTYYSECMSSLIITKDALISILGFVGFLVGTFWALHELIQPQDLSSFQNSTGTLKQ

SEQ ID NO: 797447 - protein, 112 aa, Homo sapiens [sequence omitted]

SEQ ID NO: 797448 - protein, 1516 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKAGASFYKMTGLGPLPQALYNGEPFKHEEMNIKELKMAVLQRMMDASVYLQREVFLGTLNDRTNAIDFLMDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATAIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINMKIKLFMNCRGRLSEAPLESFYRFVLEPELMSGANDVSSLGPVAKFLDIPESPLLILNMITPEGWLVETVHSNCDLDNIHLKDTEKTVTAEYELEYLLLEGQCFDKVTEQPPRGLQFTLGTKNKPAVVDTIVMAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYERFLRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKELRDFDLDGAPYGYTPFCDSRREMDGYRFWKTGYWASHLLRRKYHISALYVVDLKKFRRIGAGDRLRSQYQALSQDPNSLSNLDQDLPNNMIYQVAIKSLPQDWLWCETWCDDESKQRAKTIDLCNNPKTKESKLKAAARIVPEWVEYDAEIRQLLDHLENKKQDTILTHDEL

SEQ ID NO: 797449 - protein, 1133 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKAGASFYKMTGLGPLPQALYNGEPFKHEEMNIKELKMAVLQRMMDASVYLQREVFLGTLNDRTNAIDFLMDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATAIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINMKIKLFMNCRGRLSEAPLESFYRFVLEPELMSGANDVSSLGPVAKFLDIPESPLLILNMITPEGWLVETVHSNCDLDNIHLKDTEKTVTAEYELEYLLLEGQCFDKVTEQPPRGLQFTLGTKNKPAVVDTIVMAHHVSII

SEQ ID NO: 797450 - protein, 404 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKMEMDGYRFWKTGYWASHLLRRKYHISALYVVDLKKFRRIGAGDRLRSQYQALSQDPNSLSNLDQDLPNNMIYQVAIKSLPQDWLWCETWCDDESKQRAKTIDLCNNPKTKESKLKAAARIVPEWVEYDAEIRQLLDHLENKKQDTILTHDEL

SEQ ID NO: 797451 - protein, 1563 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKAGASFYKMTGLGPLPQALYNGEPFKHEEMNIKELKMAVLQRMMDASVYLQREVFLGTLNDRTNAIDFLMDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATAIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINMKIKLFMNCRGRLSEAPLESFYRFVLEPELMSGANDVSSLGPVAKFLDIPESPLLILNMITPEGWLVETVHSNCDLDNIHLKDTEKTVTAEYELEYLLLEGQCFDKVTEQPPRGLQFTLGTKNKPAVVDTIVMAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYERFLRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKELRDFDLDGAPYGYTPFCDSRREMDGYRFWKTGYWASHLLRRKYHISALYVVDLKKFRRIGAGDRLRSQYQALSQDPNSLSNLDQDLPNNMIYQVAIKSLPQDWLWCETWCDDESKQRAKTIDLCNNPKTKESKLKAAARIVPEWVEYDAEIRQLLDHLENKKQDTSSTRSMAASASGEASRSFYSWWKAKQEQVSYIGGTGPRERRGRCHTLLNNQISH

SEQ ID NO: 797452 - protein, 1563 aa, Homo sapiens; identical to SEQ ID NO: 797451

SEQ ID NO: 797453 - protein, 254 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVNNL

SEQ ID NO: 797454 - protein, 641 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKVSWDIMLSGVGQAQKDKHHMISTHVESLKKVRLTETE

SEQ ID NO: 797455 - protein, 1534 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKAGASFYKMTGLGPLPQALYNGEPFKHEEMNIKELKMAVLQRMMDASVYLQREVFLGTLNDRTNAIDFLMDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATAIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINMKIKLFMNCRGRLSEAPLERGDKNIPFLFFVDQNHCHSLSAILIDGNIQFSFMCALGRKQVAKFLDIPESPLLILNMITPEGWLVETVHSNCDLDNIHLKDTEKTVTAEYELEYLLLEGQCFDKVTEQPPRGLQFTLGTKNKPAVVDTIVMAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYERFLRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKELRDFDLDGAPYGYTPFCDSRREMDGYRFWKTGYWASHLLRRKYHISALYVVDLKKFRRIGAGDRLRSQYQALSQDPNSLSNLDQDLPNNMIYQVAIKSLPQDWLWCETWCDDESKQRAKTIDLCNNPKTKESKLKAAARIVPEWVEYDAEIRQLLDHLENKKQDTILTHDEL

SEQ ID NO: 797456 - protein, 1395 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDSIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKAGASFYKMTGLGPLPQALYNGEPFKHEEMNIKELKMAVLQRMMDASVYLQREVFLGTLNDRTNAIDFLMDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATAIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINMKIKLFMNCRGRLSEAPLESFYRFVLEPELMSGANDVSSLGPVAKFLDIPESPLLILNMITPEGWLVETVHSNCDLDNIHLKDTEKTVTAEYELEYLLLEGQCFDKVTEQPPRGLQFTLGTKNKPAVVDTIVMAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYERFLRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKELRDFDLDGAPYGYTPFCDSRREMDGYRFWKTGYWASHLLRRKYHIRISPII

SEQ ID NO: 797457 - protein, 1133 aa, Homo sapiens; identical to SEQ ID NO: 797449

SEQ ID NO: 797458 - protein, 130 aa, Homo sapiens
MIYQVAIKSLPQDWLWCETWCDDESKQRAKTIDLCNNPKTKESKLKAAARIVPEWVEYDAEIRQLLDHLENKKQDTSSTRSMAASASGEASRSFYSWWKAKQEQVSYIGGTGPRERRGRCHTLLNNQISH

SEQ ID NO: 797459 - protein, 157 aa, Homo sapiens
NIENPNQVAQTTKKVTQLYLDGPKELSRREREEIEKQKAKERYMKMHLAGKTEQAKADLARWPSSGNSGRRLPGRRKRKGKQKMMPHCQENECSRSPCISNRDPWEEMPGTWAALPGPLLCLAHPVPWRRRNSPSWPGAPHGLGPPLHYGLSLVSPV

SEQ ID NO: 797460 - protein, 124 aa, Homo sapiens
KEELVPFLLKLFQSIEKEGILPNSFYEASIILIPKPGRDLCPSCQPYSGVSIATTTQMQSQFIPSHTQLHTSSSRTDSRLLDIQANVLLSMSSLGTNSVGWGISPTLMAILFLFLKFFSNFIKV

SEQ ID NO: 797461 - protein, 214 aa, Homo sapiens [sequence omitted]

SEQ ID NO: 797462 - protein, 214 aa, Homo sapiens [sequence omitted]

SEQ ID NO: 797463 - protein, 149 aa, Homo sapiens
MARVASAQGLCDITKGLAPGAQSSSCEGKQTRHEQLPSPSLLTMWTLKSSLVLLLCLTCSYAFMFSSLRQKTSEPQGKVPCGEHFRIRQNLPEHTQGWLGSKWLWLLFAVVPFVILKCQRDSEKNKVRMAPFFLHHIDSISGVSGKRMF

SEQ ID NO: 797464 - protein, 73 aa, Homo sapiens
ALPAQPPPRRPPRAGASQAAFRTWGLLLLSPTGALAVNPSRRQEMTIRYQGRQYRLRMAFLQKVSKLRPGPGD

SEQ ID NO: 797465 - protein, 126 aa, Homo sapiens
MGVLDLHSYIAVIDQGQEAAACFPPHLCSTEWPVTKHSSCITLPAMPLQPSKTATPSFIFYDSGKKGGNWNLFQGLGARQSLVLGLELRLPFFVCFVVFFFFETESHSVTQAGVQWRDLGSLQPPP

SEQ ID NO: 797466 - protein, 134 aa, Homo sapiens
PCPAAPAAAGPGPCLRALRPGACPASADLKHSDGTRTCAKLYDKSDPYYENCCGGAELSLESGADLPYLPSNWANTASSLVVAPRCELTVWSRQGKAGKTHKFSAGTYPRLEEYRRGILGDWSNAISALYCRCS

SEQ ID NO: 797467 - protein, 134 aa, Homo sapiens; identical to SEQ ID NO: 797466

SEQ ID NO: 797468 - protein, 426 aa, Homo sapiens
PTRPLRNRRSLAALAPSNPDMLLLLLLLPLLWGTKGMEGDRQYGDGYLLQVQELVTVQEGLCVHVPCSFSYPQDGWTDSDPVHGYWFRAGDRPYQDAPVATNNPDREVQAETQGRFQLLGDIWSNDCSLSIRDARKRDKGSYFFRLERGSMKWSYKSQLNYKTKQLSVFVTDPPWNLTMTVFQGDATASTALGNGSSLSVLEGQSLRLVCAVNSNPPARLSWTRGSLTLCPSRSSNPGLLELPRVHVRDEGEFTCRAQNAQGSQHISLSLSLQNEGTGTSRPVSQVTLAAVGGAGATALAFLSFCIIFIIVRSCRKKSARPAAGVGDTGMEDAKAIRGSASQGPLTESWKDGNPLKKPPPAVAPSSGEEGELHYATLSFHKVKPQDPQGQEATDSEYSEIKIHKRETAETQACLRNHNPSSKEVRG

SEQ ID NO: 797469 - protein, 451 aa, Homo sapiens
PTRPLRNRRSLAALAPSNPDMLLLLLLLPLLWGTKGMEGDRQYGDGYLLQVQELVTVQEGLCVHVPCSFSYPQDGWTDSDPVHGYWFRAGDRPYQDAPVATNNPDREVQAETQGRFQLLGDIWSNDCSLSIRDARKRDKGSYFFRLERGSMKWSYKSQLNYKTKQLSVFVTALTHRPDILILGTLESGHSRNLTCSVPWACKQGTPPMISWIGASVSSPGPTTARSSVLTLTPKPQDHGTSLTCQVTLPGTGVTTTSTVRLDVSYPPWNLTMTVFQGDATASTALGNGSSLSVLEGQSLRLVCAVNSNPPARLSWTRGSLTLCPSRSSNPGLLELPRVHVRDEGEFTCRAQNAQGSQHISLSLSLQNEGTGTSRPVSQVTLAAVGGAGATALAFLSFCIIFIIVRSCRKKSARPAAGVGDTGMEDAKAIRGSASQVSDVGFSTPSIQPGHL

SEQ ID NO: 797470 - protein, 398 aa, Homo sapiens
IRNTVPASSLSSLQSVHKRKRERERERDRESRDQVKEWGCCSHSDLRSWKIAKDAEGNEDDQRRGCAFRLGCEKTPSFPHCLQPVASRGKAPQRHPFPEALRGPFSQFRYEPPPGDLDGFPGVFEGAGSRKRKSMPTKMPYNHPAEEVTLALHSEENKNHGLPNLPLLFPQPPRPKYDSQMIDLCNVGFQFYRSLEHFGGKPVKQEPIKPSAVWPQPTPTPFLPTPYPYYPKVHPGLMFPFFVPSSSPFPFSRHTFLPKQPPEPLLPRKAEPQESEETKQKVERVDVNVQIDDSYYVDVGGSQKRWQCPTCEKSYTSKYNLVTHILGHSGIKPHACTHCGKLFKQLSHLHTHMLTHQGTRPHKCQVCHKAFTQTSHLKRHMMQHSEVKPHNCRVCGRG

SEQ ID NO: 797471 - protein, 81 aa, Homo sapiens
PPHLYGPGTWCSNETLQENPNSAKGSHPPQATSHPEQLSKEALGDPPLLASLSPQGSSYPNHPTLLDLGTVHTRLTVFRRC

SEQ ID NO: 797472 - protein, 70 aa, Homo sapiens
PFPIQNLCPCIPQPLHCLCPLPEDPGDEEGGSSEQQEMADLLRGSGEHALNLAEKGLGPRNDQNAYFCPG

SEQ ID NO: 797473 - protein, 70 aa, Homo sapiens; identical to SEQ ID NO: 797472

SEQ ID NO: 797474 - protein, 79 aa, Homo sapiens
DPTPVLLGPVGTHRAVLAGLTHIPESQGFLCHQRTNSPTVSHSAQCLYLKLGTFSKSAVWNCVSCCPSPGPSTEPGTVP

SEQ ID NO: 797475 - protein, 99 aa, Homo sapiens
KLKSFCTAKETTIRVNRQPTEWEKIFATYSSDKGLISRIYNELKQIYKKKTNNPIKKWAKDMNRHFSYCSVLHFPKQCMKVPVVSHPPQYLVYVISFVI

SEQ ID NO: 797476 - protein, 245 aa, Homo sapiens
MDGTRTSLDIEEYSDTEVQKNQVLTLEEWQDKWVNGKTAFHQEQGHQLLKKHLDTFLKGKSGLRVFFPLCGKAVEMKWFADRGHSVVGVEISELGIQEFFTEQNLSYSEEPITEIPGTKVFKSSSGNISLYCCSIFDLPRTNIGKFDMIWDRGALVAINPGDRKCYADTMFSLLGKKFQYLLCVLSYDPTKHPGPPFYVPHAEIERLFGKICNIRCLEKVDAFEERHKSWGIDCLFEKLYLLTEK

SEQ ID NO: 797477 - protein, 245 aa, Homo sapiens; identical to SEQ ID NO: 797476

SEQ ID NO: 797478 - protein, 245 aa, Homo sapiens; identical to SEQ ID NO: 797476

SEQ ID NO: 797479 - protein, 245 aa, Homo sapiens; identical to SEQ ID NO: 797476

SEQ ID NO: 797480 - protein, 245 aa, Homo sapiens; identical to SEQ ID NO: 797476

SEQ ID NO: 797481 - protein, 228 aa, Homo sapiens
MDGTRTSLDIEEYSDTEVQKNQVLTLEEWQDKWVNGKTAFHQEQGHQLLKKHLDTFLKGKSGLRVFFPLCGKAVEMKWFADRGHSVVGVEISELGIQEFFTEQNLSYSEEPITEIPGTKVFKSSSGNISLYCCSIFDLPRTNIGKFDIYADTMFSLLGKKFQYLLCVLSYDPTKHPGPPFYVPHAEIERLFGKICNIRCLEKVDAFEERHKSWGIDCLFEKLYLLTEK

SEQ ID NO: 797482 - protein, 227 aa, Homo sapiens
MDGTRTSLDIEEYSDTEVQKNQVLTLEEWQDKWVNGKTAFHQEQGHQLLKKHLDTFLKGKSGLRVFFPLCGEISELGIQEFFTEQNLSYSEEPITEIPGTKVFKSSSGNISLYCCSIFDLPRTNIGKFDMIWDRGALVAINPGDRKCYADTMFSLLGKKFQYLLCVLSYDPTKHPGPPFYVPHAEIERLFGKICNIRCLEKVDAFEERHKSWGIDCLFEKLYLLTEK

SEQ ID NO: 797483 - protein, 173 aa, Homo sapiens
MDGTRTSLDIEEYSDTEVQKNQVLTLEEWQDKWVNGKTAFHQEQGHQLLKKHLDTFLKGKSGLRVFFPLCGKAVEMKWFADRGHSVVGVEISELGIQEFFTEQNLSYSEEPITEIPGTKVFKSSSGNISLYCCSIFDLPRTNIGKFDMIWDRGALVAINPGDRKWSTILCSTC

SEQ ID NO: 797484 - protein, 95 aa, Homo sapiens
MDGTRTSLDIEEYSDTEVQKNQVLTLEEWQDKWVNGKTAFHQEQGHQLLKKHLDTFLKGKSGLRVFFPLCGKAVEMKWFADLGTRVEMTRDLLES

SEQ ID NO: 797485 - protein, 88 aa, Homo sapiens
MDGTRTSLDIEEYSDTEVQKNQVLTLEEWQDKWVNGKTAFHQEQGHQLLKKHLDTFLKGKSGLRVFFPLCGELRSCHCTQAWATEQDS

SEQ ID NO: 797486 - protein, 245 aa, Homo sapiens; identical to SEQ ID NO: 797476

SEQ ID NO: 797487 - protein, 245 aa, Homo sapiens; identical to SEQ ID NO: 797476

SEQ ID NO: 797488 - protein, 245 aa, Homo sapiens; identical to SEQ ID NO: 797476

SEQ ID NO: 797489 - protein, 173 aa, Homo sapiens; identical to SEQ ID NO: 797483

SEQ ID NO: 797490 - protein, 236 aa, Homo sapiens
MDGTRTSLDIEEYSDTEVQKNQVLTLEEWQDKWVNGKTAFHQEQGHQLLKKHLDTFLKGKSGLRVFFPLCGKAVEMKWFADRGHSVVGVEISELGIQEFFTEQNLSYSEEPITEIPGTKVFKSSSGNISLYCCSIFDLPRTNIGKFDMIWDRGALVAINPGDRKCYADTMFSLLGKKFQYLLCVLSYDPTKHPAPFMFHSVHLEVVGQLPSWLEGGALRNTNWEARVGRFSPRVAP

SEQ ID NO: 797491 - protein, 69 aa, Homo sapiens
TPCSKSCGNPTEPCNCVIGGGGNGRQPAVSEARKTYACETKVSLKLWMVQELHLTLKSTRILRYRKTKY

SEQ ID NO: 797492 - protein, 148 aa, Homo sapiens
TELRCIVQSLKINLDSMRNLKASLENSLREVEARYALQREQLNGILLHLESELAQTRAEGQCQAQEYKALLNIKVKLEAESTAYCCLLEDGKDFNLGDALDSSNSMQTIQKTTTRRIVDGKVVSDQRHQSSETLSQQKQGTLWGAGGQ

SEQ ID NO: 797493 - protein, 111 aa, Homo sapiens
SQSAGITDVSHRPWPELHSSLRLSSVSLYGWALACQCTHPWMRIRVYPPLGSCEHNAVCTLRVCLNPCSRGMYLAWSFGDCGNPMLSLVRSGGTLSLFVIIFKFFSKLSSL

SEQ ID NO: 797494 - protein, 94 aa, Homo sapiens
LWAWDLGLGSQRKRGFEERKGSELGEGTLGRGATGLGRGLGVWGDRVWLQSGKWPPEGDSGLAQQPPGPGSRLAPRRWAPGPRTWLSLKPHSQA

SEQ ID NO: 797495 - protein, 130 aa, Homo sapiens
GYYRKVFCLAVWLTFSFPGPLARDIRLVLDFLCLYPLAFCASTFSSSSTVWDIRGNKETQGIHCYVILWVLRFLVVCILLSTFIYKVHDFQLYFAEGIGKCTSPFFSKQMSLMYIQPIYLEVSLILPLRC

SEQ ID NO: 797496 - protein, 105 aa, Homo sapiens
ASARARCAHPLTCAHCLALPSEMNPVPQMEMQKSPVFCVAHAGSCRPELFLFGHLGSSPRVLESEKSRIGVLAYSVPGKGCLPGLQLNYFLLCLHKPALPSLLCL

SEQ ID NO: 797497 - protein, 67 aa, Homo sapiens
RMALREPETPTLQVQGAPAKGLRPREALLEQELHDSSENSSCWSFAPKEFQRWHRLGVPTHWAERPH

SEQ ID NO: 797498 - protein, 123 aa, Homo sapiens
FLDSVAVLPRLECSGTISAHCNVCLLGSSDCRASAPQVAGITGAHHHAWLTVFLAEMGFHHVGQPALKLLASSNPPASASHSAGITGLSHCTKPQLQIVSFRARLDRIQTQNCEISAAQAVNQ

SEQ ID NO: 797499 - protein, 101 aa, Homo sapiens
QPKPNTGCHTAMVLKLECTSESSGGLAKTKKVLPAPSASPPPVYDAVGLGWRFCLSHTFPGDTDAAGLGTTLLRTTPRWGHSSRVARWSLKSQARNSRLLD

SEQ ID NO: 797500 - protein, 87 aa, Homo sapiens
AGKEHTTATAQGKSARRPQRRERAHDGHSAGKERTTATARGKSARRPQRGERAHDGHTAGKERMTVTAQTKSARWPHCRERAHDGHS

SEQ ID NO: 797501 - protein, 118 aa, Homo sapiens
MPSKTAENATFYYISSLLSSRSPVFNQSPKVKAGHMLEASQISAKNSADFFHPTPSCSELDFTLHPELADSLGAKHNYKATCLMRFLPLQRHTRSWFSLILWCIQRDDYLIGLFSCFS

SEQ ID NO: 797502 - protein, 99 aa, Homo sapiens
TPPTTPPTPPPLPPPTTPTDPIPSLNAATPTAPWRLGCKLPRTRNKIQSKHTLWDVRAHTPNPTATMTNGLVAKEGVRLGMVAHTCNPSTLGGQGGRIA

SEQ ID NO: 797503 - protein, 217 aa, Homo sapiens
MASTGLELLGMTLAVLGWLGTLVSCALPLWKVTAFIGNSIVVAQVVWEGLWMSCVVQSTGQMQCKVYDSLLALPQDLQAARALCVIALLLALLGLLVAITGAQCTTCVEDEGAKARIVLTAGVILLLAGILVLIPVCWTAHAIIQDFYNPLVAEALKRELGASLYLGWAAAALLMLGGGLLCCTCPPPQVERPRGPRLGYSIPSRSGASGLDKRDYV

SEQ ID NO: 797504 - protein, 75 aa, Homo sapiens
MQESMTGMSQPCAIWEGPGSIRFHLSSLIVLLSSDPNVSLPAADHMGNAGSREGTLVSEQGRSAGFYSQAPPLPQ

SEQ ID NO: 797505 - protein, 84 aa, Homo sapiens
SLTLGAVDRSCSYSAILAPPPWFGLFQVYWRSAPGPPHITSTLYPRSWSQHWSKRAQENSLEVEGLAHLMRAKHDRYQQAGFLG

SEQ ID NO: 797506 - protein, 216 aa, Homo sapiens
CLNCGKLGLPRHQVSFSPCLYGPLFILLADPEIRQENKAQWEGLGARQSHQDGLGLINVSEPLRTRIQTSNSPSRLLVRCPDRPPQTNSIRTFGGACKISRGDSGTKAKDSDARSPPACSGQRGSLLGNGMQAPGLLLEYPSVTDGQLTNAQWVRPRQGAAEQRARPLSAWERGATARRGVSAGLRLRRSSQLLDSTARAPYRSCEGAAAAAGGHR

SEQ ID NO: 797507 - protein, 417 aa, Homo sapiens
MLLPPGSLSRPRTFSSQPLQTKLMTHNGLFRPIPYLTAVSADEPTASQQPPQAQLHHYNGLFRPSSCLPAFSPGPELSEVDLTRPSSCFFAASPGPAPASWWPLQAQPLPPVGLYSPNICLKQILEAQHLPHCGPPKPSSQPFSSFYTPSSCHPVASLAKLMLHKGLSRPNFRLMATFPGQIPACLPAAKTGPGLASHWPLYIQLMPHGDLSRHSSCPRTSSPGPKLTRVSLSSPNCCLLVAYEGPKSPQVDLSRPSSCLLSASTGPTSASWGLLRAQLFLLAESTGTTAASQQPFLAQFLSSSWRPMRPKTSSGHTLQAHLLLPGGMNRPSFDLRTASAGPALASQGLFQAQLLPHGSCPRPNFFLPASSLNRHSSSLTVAHLGPTHDCRAISRPSACLLADSFLKPKTSSNQPFA

SEQ ID NO: 797508 - protein, 230 aa, Homo sapiens [sequence omitted]

SEQ ID NO: 797509 - protein, 70 aa, Homo sapiens
APPASQWLLSAQPSSWLSAAFPGPAFDFWRPLQAQNLTSSRPLQARPPASQRPARARPRPRPHSGLSTPS

SEQ ID NO: 797510 - protein, 199 aa, Homo sapiens
TGPASTSQWALQAHLFLTVASWGNAPPSREPLRAQLLPPSGLCRPSPCLRAAFPGLAFAALHPLQALDFLQSASPGPALPLGGLCRARLSSSRPVQGQLLPPGGLCRPKSFSSRLPQAQLRPLGGLSGCKSSSSQPLQAQLLLPPSGLFRPSPAHASRRPSQAPLLTFGGLCRPRQGPASCLQKACTGPASASQRTLHA

SEQ ID NO: 797511 - protein, 117 aa, Homo sapiens
SVCPLTAHAWLLPGQGLSWGSCWGQGSYAHRVAGTAPRKAGWWIAGLRGWAGQSCSGSSSRRHGPWALPALYGPRCACCSADCLLRIPDPGIPLGTLLLKRGSADRVDKNNLTQDVV

SEQ ID NO: 797512 - protein, 105 aa, Homo sapiens
EKLFVSFPHHIHMNCILFVLTSLCSNSIISIICRFISINFSSGYGSFSLLRMPGHCEFYIAEHWICCIPLKTVRLYLVTQISNVWISLILVKLTFKVFVASNSGL

SEQ ID NO: 797513 - protein, 150 aa, Homo sapiens
PNLNQSLVINENHSQLPICKLPLKLPKHKKLINRPQSTKRVSKDPVEALWDNLLHWLAEELSEENAESLSSTLPLRRSTIQLIKLKNPDDLTEQIHEFLCFWKKSLPTFTDKLRLLARHLRKIGRSDLAEELKFKWENKVFTEPQQCFDV

SEQ ID NO: 797514 - protein, 80 aa, Homo sapiens
RSSLVPALPPLHFLHQHCFPMCVATLLLGAVFFLPCCCSDRSSLLITKVCTCSWSAGATRSGSCDFSRGSLAPSDGAWAG

SEQ ID NO: 797515 - protein, 56 aa, Homo sapiens
MPGGSLHPERSPGRPFISQQLSSQWALLTSVAPSEAIAVDSDAQMVSDLPSKNPRS

SEQ ID NO: 797516 - protein, 122 aa, Homo sapiens
MSTWRTETFTPAVCTSCELWLLRQPARPRTAWGGPSDSHMGQLWSWSKRTSWLFVILSRSLAAAWLCFSCDRDHTCVLDPGCIWLTFLQWFLGTTSRDHFNAHFHMYRLLRSYCRHREERTE

SEQ ID NO: 797517 - protein, 199 aa, Homo sapiens
QHTYIPVLPASMIDIVCSPTPFLIGILSCSLPQLQDLPIEEVLIVDLCADKFLQEVSDEDEILPPKLQAALMQILEERNEILTQEQNFSQDVTLNSLVSEAFVRFFVELVGHYSLNMTVTERGERVFQREPFRKSHTSRSVRHFLDLFMETQMFAGFIQDRELRKSGVKGLFEIRAIQYLETIPESEPSGMNRILRSLG

SEQ ID NO: 797518 - protein, 208 aa, Homo sapiens
QHTYIPVLPASMIDIVCSPTPFLIGILSCSLPQLQDLPIEEVLIVDLCADKFLQEVSDEDEILPPKLQAALMQILEERNEILTQEQNFSQDVTLNSLVSEAFVRFFVELVGHYSLNMTVTERGERVFQREPFRKSHTSRSVRHFLDLFMETQMFAGFIQDRELRKSGVKGLFEIRAIQYLETIPESEPSGMNRILRSLGSKMKFLQKK

SEQ ID NO: 797519 - protein, 120 aa, Homo sapiens
HQESLRIKFTEGGRTERQKKSGPMPMSLNCLINQPWNCPTSGLIIFKDRIPVQSPDCVEIPLLPERQWMYLKGDFTDIPKETCILSPALSALAVYWTSQVTHFITVSQYMVFLGGCSMCT

SEQ ID NO: 797520 - protein, 545 aa, Homo sapiens
GLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 797521 - protein, 287 aa, Homo sapiens
MSQAWWHTSVSPATQEAKAGGLLQPRRQRLWLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 797522 - protein, 122 aa, Homo sapiens [sequence omitted]

SEQ ID NO: 797523 - protein, 74 aa, Homo sapiens
CNGNGMMKPSWEQGCTENRRRFCGIPARKPQPEPNHEETSGQPKLRDNLHIKRLGISESDKVMKIKERLRSFPD

SEQ ID NO: 797524 - protein, 107 aa, Homo sapiens
RGGSTGRNQPGRGEVAFQTRPWAEQRPQMEEEEERTGQCGEGLRLLGAERSPITPAPSLGGLLTFLEGAAPPSCSPHLPAACTCLSRSLTPSQAHTWVYVGLCHQLQ

SEQ ID NO: 797525 - protein, 101 aa, Homo sapiens
KPGTLWSCTSPYTPQQKLASNQLLETMLVGTTRVPGHAQSLALKRRFNQNKCMLSRPGWPYVPARQLSGGDICYIQMWTQAPTKANTCHLKGHLNMAACFQ

SEQ ID NO: 797526 - protein, 199 aa, Homo sapiens
RGPPRKFSQPEPSAVLKRHPQPEFFGDLPRKPPLPSSASESSLPAAVAGFSSRHPLSPGFGAAGTPRWRSGGLVHSGGARPGLRPSHPPRRRPLPPASSLGHPPAKPPLPPGPVDMQSFRRPSAASIDLRRTRSAAGLHFQDRQPEDIPQVPDEIYELYDDVEPRDDSSPSPKGRGLLVACPSPCKTFGARPFSAMLLV

SEQ ID NO: 797527 - protein, 320 aa, Homo sapiens
RGPPRKFSQPEPSAVLKRHPQPEFFGDLPRKPPLPSSASESSLPAAVAGFSSRHPLSPGFGAAGTPRWRSGGLVHSGGARPGLRPSHPPRRRPLPPASSLGHPPAKPPLPPGPVDMQSFRRPSAASIDLRRTRSAAGLHFQDRQPEDIPQVPDEIYELYDDVEPRDDSSPSPKGRDEAPSVQQAARRPPQDPALRKEKDPQPQQLPPMDPKLLKQLRKAEKAEREFRKKFKFEGEIVVHTKMMIDPNAKTRRGGGKHLGIRRGEILEVIEFTSNEEMLCRDPKGKYGYVPRTALLPLETEVYDDVDFCDPLENQPLPLGR

SEQ ID NO: 797528 - protein, 67 aa, Homo sapiens
DTLSKCFCQQKDIGGFTVAQVRERKLCTVSALSLLQTSWCHSSSHSLSSSVTSKTFALSEWILLRQP

SEQ ID NO: 797529 - protein, 177 aa, Homo sapiens
KAKGKKVAPAPAVMKKQEAKKVVNPLFEKRPKNFGIGQDIQPKRDLAHLVKRPCYIRLQRQRAILCKRLKVPPAIDQFAQALDCQTATQLLKLAHKYRLKTKQEKGQRLLAPAEKKAAGKGDVPTKRPPVLPAGVNTVTTLVENMKAQLVVIAHDVDPIELVTFLPALCRKMGVPYC

SEQ ID NO: 797530 - protein, 67 aa, Homo sapiens
TWKKRTTLGDFPVSAFYPMAGPRQGSKTLLGNLQSYWPEEPEARVRDKQPLESEEENPEKESPKFVA

SEQ ID NO: 797531 - protein, 135 aa, Homo sapiens
TVEQKGSSSMSWGRCRERRQGEEGVRFARGTPTRTGSDGASPSEDLTFMQKHQTTRRAPSIPEPPTRNPQSICMCDPEVQTDAGRLRWVLTLAGQTKPSRGQFSPPQRSVQLKGAPELSAAQGFRLFLTFKHEER

SEQ ID NO: 797532 - protein, 125 aa, Homo sapiens
GDLEDPSASFHQYKECFITNFISGRKLIHVNCSNLPQMGITNFEDMKAISRHTQELLEIEEPLFKRSISLPYRDIIGLYLEQKGHTGIKSDSLTLSEFVKAAGLQDYAPEITAPEENEELPCTEP

SEQ ID NO: 797533 - protein, 78 aa, Homo sapiens
DCRVPTSILGTSLAPIITAAPGGGSTGGSGFCTGKSKGLYPSPTSKHAFYNCVDEHTYEEACQEGLVFDTSCSCCNWA

SEQ ID NO: 797534 - protein, 76 aa, Homo sapiens
VFKPTRSIEQKKTEEGPSGPLPVLVNKALLKPGAHLLAHSSRVTLRQASRHVMRTLKQHHGEVRWRGTEDPPADSQ

SEQ ID NO: 797535 - protein, 46 aa, Homo sapiens
TDEINFLMQLYEEEIRELQSQISDTSVVLSMDNSCSLDMDSIIAEV

SEQ ID NO: 797536 - protein, 103 aa, Homo sapiens
MDPAPESPTVRASPCGEHVTPEAPYPGGGPCPCLLQLRSPCGAPPIHSLIPRAWLPGREAESNRGGKLHPCHYQKLRLRGHRPPRDLPGLSQAVHPAHCGATT

SEQ ID NO: 797537 - protein, 124 aa, Homo sapiens
ASNFPQLLGASTSVASLGPFPTPTLLKNMGNFWACYVEPLKYEYFVSLVRKHWGPDGEKMFCHKKISWSGPCLGLAQGCSGSVRTRQEGGAGRKGRTHFFIHSAQQVGDRGCPGVGGAGSSDCF

SEQ ID NO: 797538 - protein, 157 aa, Homo sapiens
MRPLLPGGEAQPGDTGPILPNGDTSGSGSQVPRKTFLATGDTRTSGTDGGRMCSCSLFSRRPENGRSRVGADGRQGLRPKAGAPPMPDLLGHRICTDIGKGWRMDGGRTCSCSSFCRCPERGARRSSPDAPGLALDFPLLLDLLWHLCSWTSQPLEL

SEQ ID NO: 797539 - protein, 176 aa, Homo sapiens
GPGQGGPGATASTCDQRCWGDLGMRPLLPGGESLETQAPSFPMGTLQGAALRSRERPSWPQETHGHRERTEEGCAVAAFSADALRTGGQELEQTVDRASDLRQEHPLCQTSWVTGYARTLGRDGGWTEEGRAVAALSADALREEQEGPRQMLLDLLWTFPCSWTCSGTCALGLHSL

SEQ ID NO: 797540 - protein, 152 aa, Homo sapiens
MRPLLPGGEAQPGDTGPILPNGDTSGSGSQVPRKTFLATGDTRTSGTDGGRMCSCSLFSRRPENGRSRVGADGDRASDLRQEHPLCQTSWVTGYARTLGRDGGWTEEGRAVAALSADALREEVGAPLLWFECFSPPKLMLKFHCHCNSMKSD

SEQ ID NO: 797541 - protein, 70 aa, Homo sapiens
MELGQAGQGNRLTGRFPPKKPRDRVSHKPRARASGSNTAHAIPPRVATVTHEHTQRKINDPPTRRQPWQG

SEQ ID NO: 797542 - protein, 103 aa, Homo sapiens
MNKVAGLSKMLKLWPHFVCAHVCVYMSYWCDGSLRGYSLPVTCFHISHKTGMKRKEELNHSLRQVDLWQTKSPQLGLHGGQSDFLPSEASRATFSSSPSSNLA

SEQ ID NO: 797543 - protein, 104 aa, Homo sapiens
KCSPLWQRELHFCSIHLPSCSAVPPFGGCCSSPLPRLGHPCRTWEPKPPSHVSLVPRCTAAPLLPSRQRSLSSQLLFRTFPPYRFWHCALLLTCIFFSMIQEGG

SEQ ID NO: 797544 - protein, 142 aa, Homo sapiens
WERKVFALHNTFMSSTHPLPEVAHVKHLSASQKALKEKEKASWSSLSMDEKVELYRIKFKESFAEMNRGSNEWKTVVGGAMFFIGFTALVIMWQKHYVYGPLPQSFDKEWVAKQTKRMLDMKVNPIQGLASKWDYEKNEWKK

SEQ ID NO: 797545 - protein, 105 aa, Homo sapiens
MASWQSPCPVDYKNFVIGEPSWRESFAEMNRGSNEWKTVVGGAMFFIGFTALVIMWQKHYVYGPLPQSFDKEWVAKQTKRMLDMKVNPIQGLASKWDYEKNEWKK

SEQ ID NO: 797546 - protein, 149 aa, Homo sapiens
VQHERIHTGEKPYECKECGKAFSRGYHLTQHQKIHTGEKPFKCKECGKAFSWGSSLVKHERVHTNEKSYECKDCGKAFGSGYQLSVHQRFHTGEKLYQRKEFGKTFTRGSKLVHERTHSNDKPYKYNECGEAFLWTTYSNEKIDTDETL

SEQ ID NO: 797547 - protein, 85 aa, Homo sapiens
LISLVLNSEFEFTFPNGNKIKGWMRGQECRNSRIGTEGILRATQKWLKSSGMIMTQNGKQLFSVFYVLGTISNVLQELSLLFSQF

SEQ ID NO: 797548 - protein, 219 aa, Homo sapiens
AVVSTQRAYYGRGSTDSLFFGKMAEYDLTTRIAHFLDRHLVFPLLEFLSVKEIYNEKELLQGKLDLLSDTNMVDFAMDVYKNLYSDDIPHALREKRTTVVAQLKQLQAETEPIVKMFEDPETTRQMQSTRDGRMLFDYLADKHGFRQEYLDTLYRYAKFQYECGNYSGAAEYLYFFRVLVPATDRNALSSLWGKLASEILMQNWDAAMERPYTVKRDHR

SEQ ID NO: 797549 - protein, 209 aa, Homo sapiens
LGAAGCKSAEAELAEYDLTTRIAHFLDRHLVFPLLEFLSVKEIYNEKELLQGKLDLLSDTNMVDFAMDVYKNLYSDDIPHALREKRTTVVAQLKQLQAETEPIVKMFEDPETTRQMQSTRDGRMLFDYLADKHGFRQEYLDTLYRYAKFQYECGNYSGAAEYLYFFRVLVPATDRNALSSLWGKLASEILMQNWDAAMERPYTVKRDHR

SEQ ID NO: 797550 - protein, 219 aa, Homo sapiens; identical to SEQ ID NO: 797548

SEQ ID NO: 797551 - protein, 112 aa, Homo sapiens
SSGINAEGPLRPGEHRLPFLWQEDGRMLFDYLADKHGFRQEYLDTLYRYAKFQYECGNYSGAAEYLYFFRVLVPATDRNALSSLWGKLASEILMQNWDAAMERPYTVKRDHR

SEQ ID NO: 797552 - protein, 131 aa, Homo sapiens
QIASSGLTMEVDAPKSQDLAKIMADIRDQYDELARKNREDLDKYWSQQIEESTTVVTTQSVEVAAAEMMLMELRRTVQSLETDLDSMRNLKASLENSLRDLEARYTLQMEQLNGILLHLESELAQTQAERQ

SEQ ID NO: 797553 - protein, 91 aa, Homo sapiens
KGAHLAKVCPRGRLGCCDDGYTGPCTRLSSRSCKRRHKNHSSFQEVPAASSTQQHCHHCKQPLTADLRMNMRAREEAAQPAASAAQFGRAC

SEQ ID NO: 797554 - protein, 141 aa, Homo sapiens
AYLSGVRDQGAGPTPLPLRRSPEPARSRKRGPGGRQVSGGGDGDGRGGGPGPGGPCGPAESPVGPRGQAQAEAAAGAYAGRSPDPSRAGGGRERGGKPGRERGRSRRLPWLPQPGPGASAGAGRDDAGCRARGLGSRRGRV

SEQ ID NO: 797555 - protein, 98 aa, Homo sapiens
DRPFITLLPATTLMSLTDSKQGKNRSGVRMFKDVDFLAPASGELWDRLRLTCSRPFTRHQSFGLAFLRVCSSLDSLDDSVVGPSALLSSVLNKVGEMF

SEQ ID NO: 797556 - protein, 70 aa, Homo sapiens
RTRSDPFPYLPTLSAGTSLLGCVSHLENIFSISLPEHHSLVLCSLRLSTGTSGAYCLKNAVIQAYTKSSS

SEQ ID NO: 797557 - protein, 119 aa, Homo sapiens
YFSDYGPRVMVIVTKKVDYWDKDVRQKLENCTKIFEKNVYVDKNLTEFWLDAYVQYLKGNSQDPNEKNTFMNNIPDFLSNFPNFQHDINISSSNEIISSRGFIQTTDVSSSAKKKILLF

SEQ ID NO: 797558 - protein, 113 aa, Homo sapiens
VPGRQTDGPGRRVMQCADSRMITSAESHPEFHSGIPPDFPSWIFDRLLTFVMGNAELMVFLFKSMLSSVFPVSILVIKQSPPFSYVHTSSPSASPVSSASRVYFKFVHFSSFP

SEQ ID NO: 797559 - protein, 105 aa, Homo sapiens [sequence omitted]

SEQ ID NO: 797560 - protein, 108 aa, Homo sapiens
MADLANEEKPAIAPPVFVFQKDKGQKSPAEQKNLSDSGEEPRGEAEAPHHGTGHPESAGEHALEPPAPAGASASTPPPPAPEAQLPPFPRELAGEEEKTLPLNPEGIP

SEQ ID NO: 797561 - protein, 58 aa, Homo sapiens
MSVSRNSQGTPLQTDNAACSPTDPLAGFTVTSLNRSPSAQVTCLGPLATVGWVLLEAT

SEQ ID NO: 797562 - protein, 114 aa, Homo sapiens
EGLSGLEVYFQGESLTYLARFCQVLAVVSSSPLRPLHRLLECPHDTTVGLLQSEQLKREQGRSYQIFMFEVMHHLFHEYPVDYFDQLVQSGRELHKGMNTPLARIIGGHLGSCV

SEQ ID NO: 797563 - protein, 282 aa, Homo sapiens
RSGQLLDAVHAAVLAGASAGLCAFQPEKDELLASLEKTIRPDVDQLLRQRARVAGRLRTDIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKVCSVGTGWHGVAVGLGAQMVAGRTAGCVVQKFKSDSGLAQRRFIRGWGLCIFLPFVLSQLEPGCKKVS

SEQ ID NO: 797564 - protein, 263 aa, Homo sapiens
MGRRGRSASLLASPSRGPLHIPICEAPCGGDSRPVSSIPADIRGPLESCLRREVDPQLPRVVQTLLRTVEASLEAVRTLLAQGMDRLSHRLRQSPSGTRLRREVYSFGEMPWDLALMQTCYREAERSRGRLGQLAAPFGFLGMQSLVFGAQDLAQQLMADAVATFLQLADQCLTTALNCDQAAQRLERVRGRVLKVCSVGTGWHGVAVGLGAQMVAGRTAGCVVQKFKSDSGLAQRRFIRGWGLCIFLPFVLSQLEPGCKKVS

SEQ ID NO: 797565 - protein, 120 aa, Homo sapiens
EIIMGYKIKMPQANILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 797566 - protein, 72 aa, Homo sapiens
EIIMGYKIMDAQANILVSPLVYLYPDIPKEEAFGKYCRPESQEHPEADPGSAAPYLKTKFICVTPFIDAVWK

SEQ ID NO: 797567 - protein, 66 aa, Homo sapiens
GALPFLVSVAISSGSCSDNNAAVPTVLEGATTVISAAAVLRDPHDGAREIILEAMTISAVAIAAEM

SEQ ID NO: 797568 - protein, 77 aa, Homo sapiens
KCVITVGGSPGPFSTLFLESFHETLVHFPQKLRSQGLDIWISPKPQWFYVARTKNPWWHKQFEKAGNDLLGPYRKSS

SEQ ID NO: 797569 - protein, 126 aa, Homo sapiens
SPPHLLQTRVRDQTRPEGPSALWLGWCFLLSLSLMGHSWRHLLCSDHFFFFFFFETESRFIARLEYNDTISAHCKLRLLGSHHSPASASRVAGTTATRHHARLIFVFFVETGFHHVSQDGLDLLTS

SEQ ID NO: 797570 - protein, 68 aa, Homo sapiens
MVNGCNWENFTEALGHLKNTLLYQKPLNCVNLKWISCTLCKLYLNKALVKTLLLTPLCTSFTTLCFLE

SEQ ID NO: 797571 - protein, 323 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 797572 - protein, 165 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRKK

SEQ ID NO: 797573 - protein, 95 aa, Homo sapiens
LNIICFLLQFNCVRNTPAFLAERLHRALKGIGTDEFTLNRIMVSRSEIDLLDIRTEFKKHYGYSLYSAIKSILLETMKSHSVKSVVYSNPGSTCS

SEQ ID NO: 797574 - protein, 323 aa, Homo sapiens; identical to SEQ ID NO: 797571

SEQ ID NO: 797575 - protein, 330 aa, Homo sapiens [sequence omitted]

SEQ ID NO: 797576 - protein, 317 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDPGQTTFV

SEQ ID NO: 797577 - protein, 437 aa, Homo sapiens
QSGGVERPEEGQEEGVRSRSGPGASAEHLRPRLTPSLAVCSQFTRTPVSPTALWISVISAQGKGGISWHLSGYTVSLCHLDYSAVTQSQLTAALTFCAQVVLPPQPPKSWDHTCTPPHLVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 797578 - protein, 305 aa, Homo sapiens
MASIWVGHRGTVRDYPDFSPSVDAEAIQKAIRGIGTDEVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 797579 - protein, 142 aa, Homo sapiens
MGTCPIGQTFNLMGEDLRTSLMQSTLKKSMKGAGTNEDALIEILTTRTSRQMKDISQAYYTVYKKSLGDDISSETSGDFRKALLTLADGRRLAIFSHQVGIYATNLFDCVFPLFLILFWPSNILLIDDYHTLISILPDGRKP

SEQ ID NO: 797580 - protein, 323 aa, Homo sapiens; identical to SEQ ID NO: 797571

SEQ ID NO: 797581 - protein, 351 aa, Homo sapiens
MASIWVGHRGTVRDYPDFSPSVDAEAIQKAIRGIGTDEKMLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLMGFSNSSTLLLLILFKRTSKYKQQLVFLTGIFIVL

SEQ ID NO: 797582 - protein, 323 aa, Homo sapiens; identical to SEQ ID NO: 797571

SEQ ID NO: 797583 - protein, 284 aa, Homo sapiens
MLISILTERSNAQRQLIVKEYQAAYGKELKDDLKGDLSGHFEHLMVALVTPPAVFDAKQLKKSMKGAGTNEDALIEILTTRTSRQMKDISQAYYTVYKKSLGDDISSETSGDFRKALLTLADGRRDESLKVDEHLAKQDAQILYKAGENRWGTDEDKFTEILCLRSFPQLKLTFDEYRNISQKDIVDSIKGELSGHFEDLLLAIVNCVRNTPAFLAERLHRALKGIGTDEFTLNRIMVSRSEIDLLDIRTEFKKHYGYSLYSAIKSDTSGDYEITLLKICGGDD

SEQ ID NO: 797584 - protein, 186 aa, Homo sapiens
WRGCGEIGTLLYCWWDCKLVQPLWKSVGRFLRDLELEIPFDPAIPLLGIYPKDYKSCCYKDTCTRMFIAALFTIAFTVFLSLYPIYYSIFCLPVSLPTSLPKLFRQNSPRNSLANCQILWPLSVPIFCHLSVEHSEYFLNFLPQLSIHCSHHSCCLFTSSFAAHLFLLVCHRAPSGMPGLPFLFPP

SEQ ID NO: 797585 - protein, 274 aa, Homo sapiens
MGTDSRAAKALLARARTLHLQTGNLLNWGRLRKKCPSTHSEELHDCIQKTLNEWSSQINPDLVREFPDVLECTVSHAVEKINPDEREEMKVSAKLFIVESNSSSSTRSAVDMACSVLGVAQLDSVIIASPPIEDGVNLSLEHLQPYWEELENLVQSKKIVAIGTSDLDKTQLEQLYQWAQVKPNSNQVNLASCCVMPPDLTAFAKQFDIQLLTHNDPKELLSEASFQEALQESIPDIQAHEWVPLWLLRYSVIVKSRGIIKSKGYILQAKRRGS

SEQ ID NO: 797586 - protein, 274 aa, Homo sapiens; identical to SEQ ID NO: 797585

SEQ ID NO: 797587 - protein, 274 aa, Homo sapiens; identical to SEQ ID NO: 797585

SEQ ID NO: 797588 - protein, 216 aa, Homo sapiens
MGTDSRAAKALLARARTLHLQTGNLLNWGRLRKKCPSTHSEELHDCIQKTLNEWSSQINPDLVREFPDVLECTVSHAVEKINPDEREEMKVSAKLFIVESNSSSSTRSAVDMACSVLGVAQLDSVIIASPPIEDGVNLSLEHLQPYWEELENLVQSKKIVAIGTSDLDKTQLEQLYQWAQAWGVKMMHLIALEVPVGCLVSGLERSELTSHRGSCL

SEQ ID NO: 797589 - protein, 117 aa, Homo sapiens
MRGLPLLSLLFSACPLVSRRKTSLFILLSWPCARSTLGQGEAWENGRRGALPTASLSAGPIHTKTLQLWALLEQPEAAETFQGLPILSPRREIVPSPHLGDSGRSVTFCIDSSWSLH

SEQ ID NO: 797590 - protein, 355 aa, Homo sapiens
MPALSTGSGSDTGLYELLAALPAQLQPHVDSQEDLTFLWDMFGEKSLHSLVKIHEKLHYYEKQSPVPILHGAAALADDLAEELQNKPLNSEIRELLKLLSKPNVKALLSVHDTVAQKNYDPVLPPMPEDIDDEEDSVKIIRLVKNREPLGATIKKDEQTGAIIVARIMRGGAADRSGLIHVGDELREVNGIPVEDKRPEEIIQILAQSQGAITFKIIPGSKEETPSKEGKMFIKALFDYNPNEDKAIPCKEAGLSFKKGDILQIMSQDDATWWQAKHEADANPRAGLIPSKHFQERRLALRRPEILVQPLKVSNRKSSGFRKSFRLSRKDKKTNKSMYECKKSDQYDTADVPTYE

SEQ ID NO: 797591 - protein, 355 aa, Homo sapiens; identical to SEQ ID NO: 797590

SEQ ID NO: 797592 - protein, 110 aa, Homo sapiens
MLKHGRAGVPMEVMGLMLGEFVDDYTVRVIDVFAMPQSGTGVSVEAVDPVFQAKMLDMLKQTGRPEMVVVGITVTLALVVGFLVWISTLSRALKPCRRELWQWLWIPFRV

SEQ ID NO: 797593 - protein, 139 aa, Homo sapiens
MLWGRGPPTDAPAVDTAEQVYISSLALLKMLKHGRAGVPMEVMGLMLGEFVDDYTVRVIDVFAMPQSGTGVSVEAVDPVFQAKMLDMLKQTGRPEMVVVGITVTLALVVGFLVWISTLSRALKPCRRELWQWLWIPFRV

SEQ ID NO: 797594 - protein, 109 aa, Homo sapiens
MMVLGHEPRQTTSNLGHLNKPSIQALIHGLNRHYYSITINYRKNELEQKMLLNLHKKSWMEGLTLQDYSEHCKHNESVVKEMLELAKNYNKAVEEEDQMTPEQLAIKEC

SEQ ID NO: 797595 - protein, 266 aa, Homo sapiens
MVRYSLDPENPTKSCKSRGSNLRVHFKNTRETAQAIKGMHIRKATKYLKDVTLQKQCVPFRRYNGGVGRCAQGKPMGLDTQVGGPKRVLNYCCIMLKNAESNAELKGLDVDSLVIEHIQVNKGAKMRRRTYRAHGRINPYMSSPWQIEMILTEKEQIVPKPEEEVAQKKRSSLKELAETRPVAGSKSDYTPLFSDDKATKNLLGHPPERSKRTGGDTQRTAMPPTNRATGRYQNRGQADQVRPAPSPHIPRRRHEPGQQRNKTAQH

SEQ ID NO: 797596 - protein, 266 aa, Homo sapiens; identical to SEQ ID NO: 797595

SEQ ID NO: 797597 - protein, 117 aa, Homo sapiens
SGSGKAAQFREGSRRAAARRHPAAPSPQAPGTRLPRRHPARAFPAARMPKRKVSSAEGAAKEEPKRRSARLSAKPPAKVEAKPKKAAAKDKSSDKKAQTKGKRGAKGKQAEVANQET

SEQ ID NO: 797598 - protein, 88 aa, Homo sapiens
SGSGKAAQFREGSRRAAARRHPARAFPAARMPKRKVSSAEGAAKEEPKRRSARLSAKPPAKVEAKPKKAAAKFVRSLSTHSSYRRGQD

SEQ ID NO: 797599 - protein, 127 aa, Homo sapiens [sequence omitted]

SEQ ID NO: 797600 - protein, 70 aa, Homo sapiens
ALRSSSGFAGGGDGDSDCDHEDKKMTTMMMVPMVIVVVIMVMVVMMKTMIRMVRMMMVIMMKMMMMVMWW

SEQ ID NO: 797601 - protein, 116 aa, Homo sapiens
PHPQPTPYQTCRISRGCGEGPHTPRQMCSVPRTAVQAVAHLRSLPASQLQPLTPPTQGRGSLVLRFIPKPMLRRPPARQSPRPWLPPSPLLHKEWWTRKGFSKVETLPKPLWRTLP

SEQ ID NO: 797602 - protein, 72 aa, Homo sapiens
NRIPGENLTKAIYTKVWAASRKTNRNDTPYTHNLKNHWEEDSQVIHHGHGSLTTSKTFMERGTCEEEVRPSV

SEQ ID NO: 797603 - protein, 54 aa, Homo sapiens
SPSSKLHLEVSSRDENITAEAGTWGRQGNHDTSSGRPLLSGLDTEPRHFSPRST

SEQ ID NO: 797604 - protein, 114 aa, Homo sapiens
IIPTSSDARTTAPMLQVERAVIAEACGRDSRRSSAEVLRKGQRVKLSTQEQSCRAEVGVEARPWPHGLRQVPEAQFAQDSLDLYQVRVLVQMVHSLVSKLAESLDVFLDAVGSR

SEQ ID NO: 797605 - protein, 731 aa, Homo sapiens
MSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 797606 - protein, 159 aa, Homo sapiens
QSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRVCLVFLCKNIPPAFSVTLLAFLSTCSEA

SEQ ID NO: 797607 - protein, 850 aa, Homo sapiens
ELHPSLAETPLYPPKLVLLGKDKKESTDESEVDKTHCLNNSVSSGTYSDYSPSQASSGSSNTRVKVGSLQTTAKDAVHNSLWGNRIAPSFPQPLDSKPLLSQREAVPPGNIPQRPDRLPMSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 797608 - protein, 47 aa, Homo sapiens
MGPWALPNHLLHDSAGSLAWAGIKEYGRGAISFHRKRTVVQEQGFLS

SEQ ID NO: 797609 - protein, 709 aa, Homo sapiens
MGKARRSPPGHHRHCEGCFNRHCHIPVEPNTSCLVISCHLLCGATFHMCKEAEHQLLCPLEQVPCLNSEYGCPLSMSRHKLAKHLQVCPASVVCCSMEWNRWPNVDSETTLHENIMKETPSEECLDTALALQDQKVLFRSLKMVELFPETREATEEEPTMNGETSVEEMGGAVGGVDIGLVPHGLSATNGEMAELSQEEREVLAKTKEGMDLVKFGQWENIFSKEHAASALTNSSASCESKNKNDSEKEQISSGHNMVEGEGAPKKKEPQENQKQQDVRTAMETTGLAPWQDGVLERLKTAVDAKDYNMYLVHNGRMLIHFGQMPACTPKERDFVYGKLEAQEVKTVYTFKVPVSYCGKRARLGDAMLSCKPSEHKAVDTSDLGITVEDLPKSDLIKTTLQCALERELKGHVISESRSIDGLFMDFATQTYNFEPEQFSSGTVLADLTAATPGGLHVELHSECVTRRHNKSSSAFTFTCNKFFRRDEFPLHFKNVHTDIQSCLNGWFQHRCPLAYLGCTFVQNHFRPPGQKAKVIYSQELKTFAIKPEVAPELSEGRKNNHLLGHGGKSQNSLTSLPLEILKYIAGFLDSVSLAQLSQVSVLMRNICATLLQERGMVLLQWKKKRYSHGGTSWRVHREIWQFSSLFSKIKSWEFNEVTSMSEHLKSCPFNIVEHKTDPILLTSMCQPREQARESLVSTFRIRPRGRYVS

SEQ ID NO: 797610 - protein, 108 aa, Homo sapiens
GSKLQCLLPGFLEVFLLASIGQVGSDIIALFLQPHEDAGGVQATTVGQNQGAFAGHSVWDWRREFPVSGICLHGAVNHSGPSSGGRRQSRSQLGCHFLKEAFPDFSSA

SEQ ID NO: 797611 - protein, 103 aa, Homo sapiens
CTHPPSAVPDRFPPQNLRNRTKPPLPAQVRFYKRDYTSSRLHGNDRASSLSTLPPWTFPNELLIYFLGKGRAQWLTPIIPALWEAKAGGSPEVRSSRPAWPTW

SEQ ID NO: 797612 - protein, 146 aa, Homo sapiens
MGFLRRLIYRRRPMIYVESSEESSDEQPDEVESPTQSQDSTPAEEREDEGASAAQGQEPEADSQELVQPKTGCELGDGPDTKRVCLRNEEQMKLPAEGPEPEADSQEQVHPKTGCERGDGPDVQELGLPNPEEVKTPEEDEGQSQP

SEQ ID NO: 797613 - protein, 281 aa, Homo sapiens
TQESFTPTEEHVLVVRLLLKHLHAFANSLKPEQASPSAHSHATSPLEEFKRAAVPRFIQQKLYLFLEHCFGHWPLDASFRAVLEMWLSYLQPWRYAPDKQASGSDSQPRCVSEKWAPFVQENLLMYTKLVVGFLNRALRTDLVSPKHALLVFRVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITEAKHTAKSISDQCAESPAGHSFLSWLGFSSMDTS

SEQ ID NO: 797614 - protein, 273 aa, Homo sapiens
MGRGCVINRPRRALHAFANSLKPEQASPSAHSHATSPLEEFKRAAVPRFIQQKLYLFLEHCFGHWPLDASFRAVLEMWLSYLQPWRYAPDKQASGSDSQPRCVSEKWAPFVQENLLMYTKLVVGFLNRALRTDLVSPKHALLVFCVAKVFAQPNLAEMIQKGEQLFLEPELVIPHRQHRLFTAPTFTGSFLSPWPPAVTDASFKVKSHVYSLEGQDCKYTPMFGPEARTLVLRLAQLITEAKHTAKSISDQCAESPAGHSFLSWLGFSSMDTS

SEQ ID NO: 797615 - protein, 187 aa, Homo sapiens
RQAPVPKGTACATRCGFAAVQKQAWEALCRCVCLSEASPGVGCVGAGPSTSIPQAGHSSDQAVQGTSAGCQAQWCPMGWPHSRPGSCLLWGSRATGSVRDVVRPGGRVLWVPRSFPGPHPSFSTQESFTPTEEHVLVVRLLLKHLHAFANSLKPEQASPSAHSHATSPLEEFKRWVALAASHHCRLP

SEQ ID NO: 797616 - protein, 123 aa, Homo sapiens
LAGAWVPGTTRKAGPSMLRAWGTRRRRDLPLSLPLCIYKRVPLYLYLTVGARECDCAVCVCSACVCAWGRPVRARRLCAQEATGGVVCVVTSYLSSPSLYFTEGWHFGGVGNKVDIKGHFSCS

SEQ ID NO: 797617 - protein, 438 aa, Homo sapiens
GVQRSRVSPALFELALCAGAEEIRELCSAGPFCEEGSTFGLPYLASLGIQSLVQQRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVTQCPTVRGRTVLAIFLPYHRAAMLLQGELGTGPPSRSTVRKTIGAPSRELPVTLFGPLKPLKLGFGPHPWNPKTGLNSPPMAIEPILADGALDKGRAMFLVAKCQVGFSSFLRSAERKAEALEAAIENFNEAKNYFAKVDCKERIRDVVYFQARLYHTLGKTQERNRCAMLFRQLHQELPSHGVPLINHL

SEQ ID NO: 797618 - protein, 425 aa, Homo sapiens
GVQRSRVSPALFELALCAGAEEIRELCSAGPFCEEGSTFGLPRAFAGKTANKLMDALKDSDLLHWKHSLSELIDISIAQKTAIWRLYGRSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVTQCPTVRGRTVLAIFLPYHRAAMLLQGELGTGPPSRSTVRKTIGAPSRELPVTLFGPLKPLKLGFGPHPWNPKTGLNSPPMAIEPILADGALDKGRAMFLVAKCQVGFSSFLRSAERKAEALEAAIENFNEAKNYFAKVDCKERIRDVVYFQARLYHTLGKTQERNRCAMLFRQLHQELPSHGVPLINHL

SEQ ID NO: 797619 - protein, 356 aa, Homo sapiens
MAKAQPGLLLKGNPVPFSPPSTMALQQAQMLLSMNSLEAVNAGVQQNNTESFAVALCHLAELHAEQGCFAAASEVLKHLKERFPPNSQHAQLWMLCDQKIQFDRAMNDGKYHLADSLVTGITALNSIEGVYRKAVVLQAQNQMSEAHKLLQKLLVHCQKLKNTEMVTQCPTVRGRTVLAIFLPYHRAAMLLQGELGTGPPSRSTVRKTIGAPSRELPVTLFGPLKPLKLGFGPHPWNPKTGLNSPPMAIEPILADGALDKGRAMFLVAKCQVGFSSFLRSAERKAEALEAAIENFNEAKNYFAKVDCKERIRDVVYFQARLYHTLGKTQERNRCAMLFRQLHQELPSHGVPLINHL

SEQ ID NO: 797620 - protein, 123 aa, Homo sapiens
SRPGLYSHLLDQLYELNVLPPTARRSRLGVLFCPRPDGTADMHIIINGEDMGPSARGLPAAQPLYAVVDVFASTKSVRLVQLEYGLPSLQTLCRLVIQRSMVHRLAIDGLHLPKELKDFCKYE

SEQ ID NO: 797621 - protein, 107 aa, Homo sapiens
IHNSIARVLTVINQTHTKKTSGNSTRARGTSPWTCGLRKHAPAPLAQQARGEPEDQAAAAEGAAVPAAEVHSERLNVTLSIKESWPKRTKEKCVFNMQFCIHSTNIY

SEQ ID NO: 797622 - protein, 125 aa, Homo sapiens
SVPAPGVQQALESAKAEGEVGVLGAGQGVLRPHSPAAWPPPTPRWSRAPHFLSSPVVSPSTQCCPEMGFCLVLLRNSTLAAGKSGDPRSCAAATLRLLLPSCSGAGSAAFSSRGARSASPSGRSY

SEQ ID NO: 797623 - protein, 111 aa, Homo sapiens
RPAETRGEEAGGDGIRGLTGLGRGSGERPRRTGVKWDRGTGGVESEGWGGKEAETRLTWVHRKGAGVQCGGPRSKRGRCGHEEPEAGSWGAGEPRGQNWGAGGGVAEPRAW

SEQ ID NO: 797624 - protein, 38 aa, Homo sapiens
KHCENPCPVLFRSVLITSACSPQSCTPCLLNQSRPSHV

SEQ ID NO: 797625 - protein, 756 aa, Homo sapiens
MPSVSKAAAAALSGSPPQTEKPTHYRYLKEFRTEQCPLFSQHKCAQHRPFTCFHWHFLNQRRRRPLRRRDGTFNYSPDVYCSKYNEATGVCPDGDESLLGVLYPLWAPPPVPAPVGAPTVHPFLARWFSHVPWEPAGSADPRASSTPAGGTTWATGLLGDFDACGSQSRECVKGVWWTLLGFRCPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQALLPVALLRHRVAHFSDANFVLGSYKTEQCPKPPRLCRQGYACPHYHNSRDRRRNPRRFQYRSTPCPSVKHGDEWGEPSRCDGGDGCQYCHSRTEQQFHPEGPVGSPVSGAFSVFSHAGLVADPSLWYPAEWSWHHVGHSRTINPEGDKPSRLGPAPENIKRGNDFACDGRADAAGMAPHVCVFPIYKSTKCNDMRQTGYCPRGPFCAFAHVEKSLGMVNEWGCHDLHLTSPSSTGSGQPGNAKRRDSPAEGGPRGSEQDSKQGVRAHGVYVFEQNHLAVFAAVHPPAPSVSSSVASSLASSAGSGSSSPTALPAPPARALPLGPASSTVEAVLALEPTPSSPTSSAVQGVAGELGMGSGGQGCWSHVVGALAAVPAWTHSGDLEWDPSTIRTRVNVGGGPAARPAMTLAREPQLLVVGGCPTRNCSGPAASPQQLLDDAGQGGRGERDSSQRPLRPQTTHRQDTRPVPS

SEQ ID NO: 797626 - protein, 315 aa, Homo sapiens
MPSVSKAAAAALSGSPPQTEKPTHYRYLKEFRTEQCPLFSQHKCAQHRPFTCFHWHFLNQRRRRPLRRRDGTFNYSPDVYCSKYNEATGVCPDGDECPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQDANFVLGSYKTEQCPKPPRLCRQGYACPHYHNSRDRRRNPRRFQYRSTPCPSVKHGDEWGEPSRCDGGDGCQYCHSRTEQQFHPEVRPSNPPGVGVAGRSQRSCGVHSVVITQKEQ

SEQ ID NO: 797627 - protein, 319 aa, Homo sapiens
ISGGGGAGAAHARCIVLTENAVGFESGGSGAERVPPADGEADPLQHKCAQHRPFTCFHWHFLNQRRRRPLRRRDGTFNYSPDVYCSKYNEATGVCPDGDECPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQDANFVLGSYKTEQCPKPPRLCRQGYACPHYHNSRDRRRNPRRFQYRSTPCPSVKHGDEWGEPSRCDGGDGCQYCHSRTEQQFHPEVRPSNPPGVGVAGRSQRSCGVHSVVITQKEQ

SEQ ID NO: 797628 - protein, 294 aa, Homo sapiens
MAPHVCVFPIYKSTKCNDMRQTGYCPRGPFCAFAHVEKSLGMVNEWGCHDLHLTSPSSTGSGQPGNAKRRDSPAEGGPRGSEQDSKQGVRAHGVYVFEQNHLAVFAAVHPPAPSVSSSVASSLASSAGSGSSSPTALPAPPARALPLGPASSTVEAVLALEPTPSSPTSSAVQGVAGELGMGSGGQGCWSHVVGALAAVPAWTHSGDLEWDPSTIRTRVNVGGGPAARPAMTLAREPQLLVVGGCPTRNCSGPAASPQQLLDDAGQGGRGERDSSQRPLRPQTTHRQDTRPVPS

SEQ ID NO: 797629 - protein, 277 aa, Homo sapiens
MPSVSKAAAAALSGSPPQTEKPTHYRYLKEFRTEQCPLFSQHKCAQHRPFTCFHWHFLNQRRRRPLRRRDGTFNYSPDVYCSKYNEATGVCPDGDECPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQDANFVLGSYKTEQCPKPPRLCRQGYACPHYHNSRDRRRNPRRFQYSWQLGRRVLRLSPRANNPRVALPRVHTGPSSTA

SEQ ID NO: 797630 - protein, 175 aa, Homo sapiens
TTVSSACRELQAQEALQNGQLGGGEGVPDLQPGVLASQAMIEKILSEDPRWQDANFVLGSYKTEQCPKPPRLCRQGYACPHYHNSRDRRRNPRRFQYSEPAGPCSEDSGWWASFPARGSRCPPRGSNGRAALVAPSSPGGEGISKHSGCGRCHGGPRVCPGDGPPHLRSVSPMQS

SEQ ID NO: 797631 - protein, 244 aa, Homo sapiens
VVRQVQNSCLDGSGVCLAGSPLCILCPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQDANFVLGSYKTEQCPKPPRLCRQGYACPHYHNSRDRRRNPRRFQYRSTPCPSVKHGDEWGEPSRCDGGDGCQYCHSRTEQQFHPEVRPSNPPGVGVAGRSQRSCGVHSVVITQKEQ

SEQ ID NO: 797632 - protein, 713 aa, Homo sapiens
MAYKMRLYWAPNTFNLIFKFLFNNIDMESPYVAHAGSNSWPQGCSCLSLPKCWDYRHEPLHQALTHLINCKEEEQWTAVRYGLQGKRRTSSKMMIFRPVIPELWEPRRVDHLSPGVQDQPRKHSETTSLPKNTKISHACSPSYVIRGRLRWEDGLSPGGGGYSEPLYPNLGDRVRPHLKTKKDDLYYVGHLKKCSQSKSVDEHNPDHMLLLKMSTGLHKMDIHGHEMDINDFTYVEEENFRLETLGRSVDRIPYALQIRILSEGTFLSSQTQKSEYSFQPMVMLTYVFFFFFFFFGDGVLLCRPGWSAVTRSRLTASSASQIHAILLPQPPEELGLQTPTTTPGSFFVFLVETGFHRVSQDGLDLLTCDPFASASQSAGITGVSHRARPTYVFRKIFKMLKDDRYISRPYEVAQLVPGLVYYVYISHYFTESSHINPHNLKGLKDGFCATETYAQNDNSRDTFFILFFFFLRWSLTLSPWLECSGVISAHCSLHLPDSSDSHASASRVSWDYRCTPPAWVIFVFLVEMGFQHVGQADLGTPDLKDPPTSASQSAEITGVSHHAWPVMLLYNLKLPVLCSVSHEGHSPKGTLEITNMLKISNKVRDVGRHSYSYREQTIPSYRLCTEERAEGMRLLELESWLDEARKLTRCGGSYIGKKTLLWFLFFQIAKVNVSDCFKHDSLTSLHSKLFLCFQNDLLSNHFYFVLKQFWLFR

SEQ ID NO: 797633 - protein, 75 aa, Homo sapiens
AHASLRHAGREPVATPNTPLLLTPGLRPTLHGSTQKAARTTHTEAGISLTTRVCRGGAVDGPAPSVPIFLPKHIL

SEQ ID NO: 797634 - protein, 60 aa, Homo sapiens
RSIQADGLVWGSSKLVPVGYGIKKLQIQCVVEDDKVGTDMLEEQITAFEDYVQSMDVAAF

SEQ ID NO: 797635 - protein, 191 aa, Homo sapiens
MLVTLGLLTSFFSFLYMVAPSIRKFFAGGVCRTNVQLPGKVVVITGANTGIGKETARELASRGARVYIACRDVLKGESAASEIRVDTKNSQVLVRKLDLSDTKSIRAFAEGFLAEEKQLHILINNAGVMMCPYSKTADGFETHLGVNHLGHFLLTYLLLERLKVSAPARVVNVSSVAHHIGKIPFHDLQSE

SEQ ID NO: 797636 - protein, 109 aa, Homo sapiens [sequence omitted]

SEQ ID NO: 797637 - protein, 135 aa, Homo sapiens
TAKDLVTRLMEVEQDQRITAEEAISHEWISGNAASDKNIKDGVCAQIERGDARAKWKKAVRVTTLMKAPGTRAVQHGCSPVGLSHKTLATPGGWQTVSAHPSHKMGSCHPSHLMAVSPQPPMEAFPATDGECHPS

SEQ ID NO: 797638 - protein, 285 aa, Homo sapiens
PAGPAAWGPGRPRQQRAGDAGGSGAPPAQGTRGTLQGDPPASHRTVGGCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRSICNDAVLSEGNSSSKPLQGVSSWNAMRLRRSLGSPGTGSLGTY

SEQ ID NO: 797639 - protein, 219 aa, Homo sapiens
EDSVWLLLDSRRRREIPRADTMRSKARARKLAKSDGDVVNNMYEPNRDLLASHSAEDEAEDSAMSPIPVGSPPPFPTSEDFTPKEGSPYEAPVYIPEDIPIPADFELRESSIPGAGLGVWAKRKMEAGERLGPCVVVPRAAAKETDFGWEQILTDVEVSPQEGCITKISEDLGSEKFCVDANQAGAGSWLKYIRVACSCDDQNLTMCQISEQVMKVKLE

SEQ ID NO: 797640 - protein, 1297 aa, Homo sapiens
EDSVWLLLDSRRRREIPRADTMRSKARARKLAKSDGDVVNNMYEPNRDLLASHSAEDEAEDSAMSPIPVGSPPPFPTSEDFTPKEGSPYEAPVYIPEDIPIPADFELRESSIPGAGLGVWAKRKMEAGERLGPCVVVPRAAAKETDFGWEQILTDVEVSPQEGCITKISEDLGSEKFCVDANQAGAGSWLKYIRVACSCDDQNLTMCQISEQVIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNFIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPYRPHPGSLPFSTAPPTFPALTPGFPGIFPPSLYPRPPLLPPTPLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDLDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQAYAMMLSLSEDTPLHTPSQGSLDAWLKVTGATSESGAFHPINHL

SEQ ID NO: 797641 - protein, 1198 aa, Homo sapiens
EDSVWLLLDSRRRREIPRADTMRSKARARKLAKSDGDVVNNMYEPNRDLLASHSAEDEAEDSAMSPIPVGSPPPFPTSEDFTPKEGSPYEAPVYIPEDIPIPADFELRESSIPGAGLGVWAKRKMEAGERLGPCVVVPRAAAKETDFGWEQILTDVEVSPQEGCITKISEDLGSEKFCVDANQAGAGSWLKYIRVACSCDDQNLTMCQISEQVIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNFIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPYRPHPGSLPFSTAPPTFPALTPGFPGIFPPSLYPRPPLLPPTPLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDLDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRHMQ

SEQ ID NO: 797642 - protein, 223 aa, Homo sapiens
MRDEIATTVFFVTRLVKKHDKLSKQQIEDFAEKLMTILFETYRSHWHSDCPSKGQAFRCIRINNNQNKDPILERACVESNVDFSHLGLPKEMTIWVDPFEVCCRYGEKNHPFTVASFKGRWEEWELYQQISYAVSRASSDVSSGTSCDEESCSKEPRVIPKVSNPKSIYQVENLKQPFQSWLQIPRKKNVVDGRVGLLGNTYHGSQKHPKCYRPAMHRLDRIL

SEQ ID NO: 797643 - protein, 116 aa, Homo sapiens
ERFSDVRGCYCSRCGAAAAFVEASTGLYPADTPRRVMVPSHSPRQVPSPSWSSLVWGARGPDLRLSEGQGFPPYSALCILGQVTYLSEPHIPCSAQCSWLQGVFEAEMNGEGKAWR

SEQ ID NO: 797644 - protein, 106 aa, Homo sapiens
EEVGDTGADWRKVAKSLGEKSTDLKEASDESVHRSLSPKLSSQAALSFTTPRVPLSFKIHTQLSRPIALGACDSQVGFYTCLAAQLGGICFWGVSGRVQGPGCGFG

SEQ ID NO: 797645 - protein, 142 aa, Homo sapiens
MSDLFVFSSKLEGTPNLFVSRVPDGVVLGVEEPEGKAQGRVRGELCPGALARIHMGHSCTRLSAEGIAMLLGTAGPSRLPAAPDASQAPLRSPWALSVAAALCSPVSCHPCGRHVVTFGHCPAQGPWGLGTFGHSFFGCLCK

SEQ ID NO: 797646 - protein, 143 aa, Homo sapiens
MLRKTCGGQQEDSRGMGPHLPRVPDGVVLGVEEPEGKAQGRVRGELCPGALARIHMGHSCTRLSAEGIAMLLGTAGPSRLPAAPDASQAPLRSPWALSVAAALCSPVSCHPCGRHVVTFGHCPAQGPWGLGTFGHSFFGCLCK

SEQ ID NO: 797647 - protein, 128 aa, Homo sapiens
CFVLFFNKGATSSVKADKPGPAWSGREQAMGSPPGPGKACFTSGEIWRYQHPFPKATGISGLSPQSWALGPPATSSAEARSPQGSSVESEVSPSQRMDASAPGSLGRRRAAAVKNPAGWQGANTRCAH

SEQ ID NO: 797648 - protein, 121 aa, Homo sapiens [sequence omitted]

SEQ ID NO: 797649 - protein, 79 aa, Homo sapiens
DAHTSHCVAMAAGIQVSMNPAATILIKCFGQHHPLKCNDQQIGNTSVPPAQQVPNLKGPESKARVLVPAPQELQDTVHE

SEQ ID NO: 797650 - protein, 444 aa, Homo sapiens
MEPPGPVRGPLQDSSWYEPSAELVQTRMAVSLTAAETLALQGTQGQEKMMMMGPKEEEQSCEYETRLPGNHSTSQEIFRQRFRHLRYQETPGPREALSQLRVLCCEWLRPEKHTKEQILEFLVLEQFLTILPEELQSWVRGHHPKSGEEAVTVLEDLEKGLEPEPQVPGPAHGPAQEEPWEKKESLGAAQEALSIQLQPKETQPFPKSEQVYLHFLSVVTEDGPEPKDKGSLPQPPITEVESQVFSEKLATDTSTFEATSEGTLELQQRNPKAERLRWSPAQEESFRQMVVIHKEIPTGKKDHECSECGKTFIYNSHLVVHQRVHSGEKPYKCSDCGKTFKQSSNLGQHQRIHTGEKPFECNECGKAFRWGAHLVQHQRIHSGEKPYECNECGKAFSQSSYLSQHRRIHSGEKPFICKECGKAYGWCSELIRHRRVHARKEPSH

SEQ ID NO: 797651 - protein, 389 aa, Homo sapiens
MAVSLTAAETLALQGTQGQEKMMMMGPKEEEQSCEYETRLPGNHSTSQEIFRQRFRHLRYQETPGPREALSQLRVLCCEWLRPEKHTKEQILEFLVLEQFLTILPEELQSWVPGPAHGPAQEEPWEKKESLGAAQEALSIQLQPKETQPFPKSEQVYLHFLSVVTEDGPEPKDKGSLPQPPITEVESQVFSEKLATDTSTFEATSEGTLELQQRNPKAERLRWSPAQEESFRQMVVIHKEIPTGKKDHECSECGKTFIYNSHLVVHQRVHSGEKPYKCSDCGKTFKQSSNLGQHQRIHTGEKPFECNECGKAFRWGAHLVQHQRIHSGEKPYECNECGKAFSQSSYLSQHRRIHSGEKPFICKECGKAYGWCSELIRHRRVHARKEPSH

SEQ ID NO: 797652 - protein, 396 aa, Homo sapiens
MMMMGPKEEEQSCEYETRLPGNHSTSQEIFRQRFRHLRYQETPGPREALSQLRVLCCEWLRPEKHTKEQILEFLVLEQFLTILPEELQSWVRGHHPKSGEEAVTVLEDLEKGLEPEPQVPGPAHGPAQEEPWEKKESLGAAQEALSIQLQPKETQPFPKSEQVYLHFLSVVTEDGPEPKDKGSLPQPPITEVESQVFSEKLATDTSTFEATSEGTLELQQRNPKAERLRWSPAQEESFRQMVVIHKEIPTGKKDHECSECGKTFIYNSHLVVHQRVHSGEKPYKCSDCGKTFKQSSNLGQHQRIHTGEKPFECNECGKAFRWGAHLVQHQRIHSGEKPYECNECGKAFSQSSYLSQHRRIHSGEKPFICKECGKAYGWCSELIRHRRVHARKEPSH

SEQ ID NO: 797653 - protein, 156 aa, Homo sapiens
MVVIHKEIPTGKKDHECSECGKTFIYNSHLVVHQRVHSGEKPYKCSDCGKTFKQSSNLGQHQRIHTGEKPFECNECGKAFRWGAHLVQHQRIHSGEKPYECNECGKAFSQSSYLSQHRRIHSGEKPFICKECGKAYGWCSELIRHRRVHARKEPSH

SEQ ID NO: 797654 - protein, 156 aa, Homo sapiens; identical to SEQ ID NO: 797653

SEQ ID NO: 797655 - protein, 444 aa, Homo sapiens; identical to SEQ ID NO: 797650

SEQ ID NO: 797656 - protein, 156 aa, Homo sapiens; identical to SEQ ID NO: 797653

SEQ ID NO: 797657 - protein, 228 aa, Homo sapiens
MEPPGPVRGPLQDSSWYEPSAELVQTRMAVSLTAAETLALQGTQGQEKMMMMGPKEEEQSCEYETRLPGNHSTSQEIFRQRFRHLRYQETPGPREALSQLRVLCCEWLRPEKHTKEQILEFLVLEQFLTILPEELQSWVRGHHPKSGEEAVTVLEDLEKGLEPEPQVPGPAHGPAQEEPWEKKESLGAAQEALSIQLQPKETQPFPKSVVPEDGQSQDKGPAQHHYEG

SEQ ID NO: 797658 - protein, 370 aa, Homo sapiens
MKVTGITILFWPLSMILLSDKIQSSKREVQCNFTEKNYTLIPADIKKDVTILDLSYNQITLNGTDTRVLQTYFLLTELYLIENKVTILHNNGFGNLSSLEILNICRNSIYVIQQGAFLGLNKLKQLYLCQNKIEQLNADVFVPLRSLKLLNLQGNLISYLDVPPLFHLELITLYGNLWNCSCSLFNLQNWLNTSNVTLENENITMCSYPNSLQSYNIKTVPHKAECHSKFPSSVTEDLYIHFQPISNSIFNSSSNNLTRNSEHEPLGKSWAFLVGVVVTVLTTSLLIFIAIKCPIWYNILLSYNHHRLEEHEAETYEDGFTGNPSSLSQIPETNSEETTVIFEQLHSFVVDDDGFIEDKYIDIHELCEEN

SEQ ID NO: 797659 - protein, 370 aa, Homo sapiens; identical to SEQ ID NO: 797658

SEQ ID NO: 797660 - protein, 370 aa, Homo sapiens; identical to SEQ ID NO: 797658

SEQ ID NO: 797661 - protein, 615 aa, Homo sapiens
TFPFSRPTWLERGGGEPAARPQTPQPTAPESRGPSGASALRCRGPTARSLPAASMLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKKKRKEEEKKCGW

SEQ ID NO: 797662 - protein, 1722 aa, Homo sapiens
TFPFSRPTWLERGGGEPAARPQTPQPTAPESRGPSGASALRCRGPTARSLPAASMLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESESLFLPLFQMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKSDESDSSLSEVHRYFRGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 797663 - protein, 1442 aa, Homo sapiens
MNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKSDESDSSLSEVHRYFRGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 797664 - protein, 1655 aa, Homo sapiens
TFPFSRPTWLERGGGEPAARPQTPQPTAPESRGPSGASALRCRGPTARSLPAASMLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKQGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 797665 - protein, 1698 aa, Homo sapiens
TFPFSRPTWLERGGGEPAARPQTPQPTAPESRGPSGASALRCRGPTARSLPAASMLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 797666 - protein, 1714 aa, Homo sapiens
TFPFSRPTWLERGGGEPAARPQTPQPTAPESRGPSGASALRCRGPTARSLPAASMLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRAKLLESEAVNENLRKNLTRATARAPYFSGSSTFSPTILSSDKETIEIIDLAKKDLEKLKRKEKRKKKSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKSDESDSSLSEVHRYFRGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 797667 - protein, 1698 aa, Homo sapiens; identical to SEQ ID NO: 797665

SEQ ID NO: 797668 - protein, 1124 aa, Homo sapiens
EKKDRGRKKATELKESIEKKKSVAGKEDNTDTDQEKKEEKGVSERENNELEVEESQEVSDHEDEEEEEEEEEDDIDGGESSDESDSESDEKANYQADLANITCEIAIKQKLIDELENSQKRLQTLKKQYEEKLMMLQHKIRDTQLERDQVLQNLGSVESYSEEKAKKVRSEYEKKLQAMNKELQRLQAAQKEHARLLKNQSQYEKQLKKLQQDVMEMKKTKVRLMKQMKEEQEKARLTESRRNREIAQLKKDQRKRDHQLRLLEAQKRNQEVVLRRKTEEVTALRRQVRPMSDKVAGKVTRKLSSSDAPAQDTGSSAAAVETDASRTGAQQKMRIPVARVQALPTPATNGNRKKYQRKGLTGRVFISKTARMKWQLLERRVTDIIMQKMTISNMEADMNRLLKQREELTKRREKLSKRREKIVKENGEGDKNVANINEEMESLTANIDYINDSISDCQANIMQMEEAKEEGETLDVTAVINACTLTEARYLLDHFLSMGINKGLQAAQKEAQIKVLEGRLKQTEITSATQNQLLFHMLKEKAELNPELDALLGHALQDLDSVPLENVEDSTDEDAPLNSPGSEGSTLSSDLMKLCGEVKPKNKARRRTTTQMELLYADSSELASDTSTGDASLPGPLTPVAEGQEIGMNTETSGTSAREKELSPPPGLPSKIGSISRQSSLSEKKIPEPSPVTRRKAYEKAEKSKAKEQKHSDSGTSEASLSPPSSPPSRPRNELNVFNRLTVSQGNTSVQQDKSDESDSSLSEVHRYFRGIINPFPASKGIRAFPLQCIHIAEGHTKAVLCVDSTDDLLFTGSKDRTCKVWNLVTGQEIMSLGGHPNNVVSVKYCNYTSLVFTVSTSYIKVWDIRDSAKCIRTLTSSGQVTLGDACSASTSRTVAIPSGENQINQIALNPTGTFLYAASGNAVRMWDLKRFQSTGKLTGHLGPVMCLTVDQISSGQDLIITGSKDHYIKMFDVTEGALGTVSPTHNFEPPHYDGIEALTIQGDNLFSGSRDNGIKKWDLTQKDLLQQVPNAHKDWVCALGVVPDHPVLLSGCRGGILKVWNMDTFMPVGEMKGHDSPINAICVNSTHIFTAADDRTVRIWKARNLQDGQISDTGDLGEDIASN

SEQ ID NO: 797669 - protein, 585 aa, Homo sapiens
TFPFSRPTWLERGGGEPAARPQTPQPTAPESRGPSGASALRCRGPTARSLPAASMLGAPDESSVRVAVRIRPQLAKEKIEGCHICTSVTPGEPQVFLGKDKAFTFDYVFDIDSQQEQIYIQCIEKLIEGCFEGYNATVFAYGQTGAGKTYTMGTGFDVNIVEEELGIISRAVKHLFKSIEEKKHIAIKNGLPAPDFKVNAQFLELYNEEVLDLFDTTRDIDAKSKKSNIRIHEDSTGGIYTVGVTTRTVNTESEMMQCLKLGALSRTTASTQMNVQSSRSHAIFTIHVCQTRVCPQIDADNATDNKIISESAQMNEFETLTAKFHFVDLAGSERLKRTGATGERAKEGISINCGLLALGNVISALGDKSKRATHVPYRDSKLTRLLQDSLGGNSQTIMIACVSPSDRDFMETLNTLKYANRARNIKNKVMVNQDRASQQINALRSEITRLQMELMEYKTGKRIIDEEGVESINDMFHENAMLQTENNNLRVRIKAMQETVDALRSRITQLVSDQANHVLARAGEGNEEISNMIHSYIKEIEDLRYSSCSVTYNAHVCFGFCNVIIFLFVGLSVQQLSMVIFQPFG

SEQ ID NO: 797670 - protein, 287 aa, Homo sapiens
RSGIAERVEKEKAQAVEQQAKKRLEQQKLTVIATSTTSPTSSTTSTISPAQKVMVAPISGSVTTGTKMVLTTKVGSPATVTFQQNKNFHQTFATWVKQGQSNSGVVQVQQKVLGIIPSSTGTSQQTFTSFQPRTATVTIRPNTSGSGGTTSNSQVITGPQIRPGMTVIRTPLQQSTLGKAIIRTPVMVQPGAPQQVMIQIIRGQPVSTAVSAPNTVSSTPGQKSLTSATSTSNIQSLASQPPRPQQGQVKLTMAQLTQLTQGHGGNQGLTVVIQGQGQTTGQLQLIP

SEQ ID NO: 797671 - protein, 177 aa, Homo sapiens
MLFLRIPVRRCHADKETRNAQANLALVIIETWVAEEELELWEIRSFAERVEKEKAQAVEQQAKKRLEQQKLTVIATSTTSPTSSTTSTISPAQKVMVAPISGSVTTGTKMVLTTKVGSPATVTFQQNKNFHQTFATWVKQGQSNSDSCGICYNHCQHRSDVPNYRQSSHYGRKSNYQ

SEQ ID NO: 797672 - protein, 209 aa, Homo sapiens
SLPQKRRGEGATSGEARLWRSCGGRLSTTSNWSSAIAVCFRKHLNMVSSGKKYSRKSGKPSVEDQFTRAYDFETEDKKDLSGSEEDVIEGKTAVIEKRRKKRSSAGVVEDMGGEVQNMLEGVGVDINKALLAKRKRLEMYTKASLKTSNQKIEHVWKTQQDQRQKLNQEYSQQFLTLFQQWDLDMQKAEEQEEKILNMFRTATKNSSTI

SEQ ID NO: 797673 - protein, 209 aa, Homo sapiens; identical to SEQ ID NO: 797672

SEQ ID NO: 797674 - protein, 76 aa, Homo sapiens
KHLNMVSSGKKYSRKSGKPSVEDQFTRAYDFETEDKKDLSGSEEDVIEGAVHLMLGSDVLQFICFEPIETIVQLSL

SEQ ID NO: 797675 - protein, 209 aa, Homo sapiens; identical to SEQ ID NO: 797672

SEQ ID NO: 797676 - protein, 262 aa, Homo sapiens
MGYSQCMETEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDNSPLGLKKEVHENHPPDFQSGFQTLLLNPVFSQKTLKPTSHHGPRPPI

SEQ ID NO: 797677 - protein, 218 aa, Homo sapiens
MGYSQCMETEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKKKTPLPKKGRGKRGDF

SEQ ID NO: 797678 - protein, 256 aa, Homo sapiens
METEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDNSPLGLKKEVHENHPPDFQSGFQTLLLNPVFSQKTLKPTSHHGPRPPI

SEQ ID NO: 797679 - protein, 262 aa, Homo sapiens; identical to SEQ ID NO: 797676

SEQ ID NO: 797680 - protein, 230 aa, Homo sapiens
MGYSQCMETEVIESLGIIIYKALDYGLKENEERELSPPLEQLIDHMANTVEADGSNDEGYEAAEEGLGDEDEKRKISAIRSYRDVMKLCAAHLPTESDAPNHYQAVCRALFAETMELHTFLTKIKSAKENLKKIQEMEKSDESSTDLEELKNADWARFWVQVMRDLRNGVKLKKVQERQYNPLPIEYQLTPYEMLMDDIRCKRYTLRKVMVNGDIPRYKRVLMHHPRFHR

SEQ ID NO: 797681 - protein, 110 aa, Homo sapiens
FPTSPPGQRVQKGRPRDSKTFFKKLPPGTFFSIGNPGECRTKTNLPIHMFEKKKSPGGDVVKVILLLPAEKNRRQKVRPQSFEALQAPPDVTTVAVEETIPSFTGRSPNH

SEQ ID NO: 797682 - protein, 288 aa, Homo sapiens
MELMALHLQANHLGKAKRKDNTIGVTVNCKDQAREASKMALLPSLQSNKDLGLSNMISSLDSASEKMAQGQLKETLGEQKSGAWTGHVDPAFCNFPSDFYKQFGVYPGMVGSGASSSCPNKEPDGKAHSEEDVPILIPETTSKNTTDDLSDIASSEDMDSSKGENNDEEDVETEPEMMTKPLSALSKDSSSDGGDSLQPTGTSQPVQGLVSPLSQAPEKQWHSQGLLQAQDPLAGLPKPERGPQSLDKPMNMLSVLRAYSSDGLAAFNGLASSTANSGCIKRPDLCGK

SEQ ID NO: 797683 - protein, 297 aa, Homo sapiens
DKRLFFFLYQNLAGEKPYKCPHCDYAGTQSASLKYHLERHHRERQNGAGPLSGQPPNQDHKDEMSSKASLFIRPDILRGAFKGLPGIDFRGGPASQQWTSGVLSSGDHSGQATGMSSEVPSDALKGTDLPSKSTHFSEIGRAYQSIVSNGVNFQGSLQAFMDSFVLSSLKKEKDMKDKALADPPSMKVHGVDGGEEKPSGKSSQRKSEKSQYEPLDLSVRPDAASLPGSSVTVQDSIAWHGCLFCAFTTSSMELMALHLQANHLGKAKRKDNTIGVTVNCKDQAREASKMALLPSLQ

SEQ ID NO: 797684 - protein, 1300 aa, Homo sapiens
MEEASLCLGVSSAEPEAEPHLSGPVLNGQYAMSQKLHQITSQLSHAFPELHPRPNPEEKPPASLEEKAHVPMSGQPMGSQMALLANQLGREVDTSLNGRVDLQQFLNGQNLGIMSQMSDIEDDARKNRKYPCPLCGKRFRFNSILSLHMRTHTGEKPFKCPYCDHRAAQKGNLKIHLRTHKLGNLGKGRGRVREENRLLHELEERAILRDKQLKGSLLQPRPDLKPPPHAQQAPLAACTLALQANHSVPDVAHPVPSPKPASVQEDAVAPAAGFRCTFCKGKFKKREELDRHIRILHKPYKCTLCDFAASQEEELISHVEKAHITAESAQGQGPNGGGEQSANEFRCEVCGQVFSQAWFLKGHMRKHKDSFEHCCQICGRRFKEPWFLKNHMKVHLNKLSVKNKSPSDPEVPVPMGGMSQEAHANLYSRYLSCLQSGFMTPDKAGLSEPSQLYGKGELPMKEKEALGKLLSPISSMAHGVPEGDKHSLLGCLNLVPPLKSSCIERLQAAAKAAEMDPVNSYQAWQLMARGMAMEHGFLSKEHPLQRNHEDTLANAGVLFDKEKREYVLVGADGSKQKMPADLVHSTKVGSQRDLPSKLDPLESSRDFLSHGLNQTLEYNLQGPGNMKEKPTECPDCGRVFRTYHQVVVHSRVHKRDRKGEEDGLHVGLDERRGSGSDQESQSVSRSTTPGSSNVTEESGVGGGLSQTGSAQEDSPHPSSPSSSDIGEEAGRSAGVQQPALLRDRSLGSAMKDCPYCGKTFRTSHHLKVHLRIHTGEKPYKCPHCDYAGTQSASLKYHLERHHRERQNGAGPLSGQPPNQDHKDEMSSKASLFIRPDILRGAFKGLPGIDFRGGPASQQWTSGVLSSGDHSGQATGMSSEVPSDALKGTDLPSKSTHFSEIGRAYQSIVSNGVNFQGSLQAFMDSFVLSSLKKEKDMKDKALADPPSMKVHGVDGGEEKPSGKSSQRKSEKSQYEPLDLSVRPDAASLPGSSVTVQDSIAWHGCLFCAFTTSSMELMALHLQANHLGKAKRKDNTIGVTVNCKDQAREASKMALLPSLQSNKDLGLSNMISSLDSASEKMAQGQLKETLGEQKSGAWTGHVDPAFCNFPSDFYKQFGVYPGMVGSGASSSCPNKEPDGKAHSEEDVPILIPETTSKNTTDDLSDIASSEDMDSSKGENNDEEDVETEPEMMTKPLSALSKDSSSDGGDSLQPTGTSQPVQGLVSPLSQAPEKQWHSQGLLQAQDPLAGLPKPERGPQSLDKPMNMLSVLRAYSSDGLAAFNGLASSTANSGCIKRPDLCGK

SEQ ID NO: 797685 - protein, 288 aa, Homo sapiens; identical to SEQ ID NO: 797682

SEQ ID NO: 797686 - protein, 130 aa, Homo sapiens
RPPRGRCWAWGGQLEDDLGLQRPPGGRSWPWTGRLDDSLGLQRPPRGRAGPGEADWRKSRAWRGCKAANARPGKAALRHGLGQQRPLGGRSWAHRGSREGGALPQEATVRKRWAWRAHCEVEAGPVEAAD

SEQ ID NO: 797687 - protein, 107 aa, Homo sapiens
ENGTAAQNLRWKTQQWTGHMVSTKGDQLTLTQTHSRHQMLKEGTDTCYTFFSAHMLLMSQTKLSLNRKGTRAQSRGKNNGFSLSSAMKCLFPLDLTVFKGKPNITAY

SEQ ID NO: 797688 - protein, 225 aa, Homo sapiens [sequence omitted]

SEQ ID NO: 797689 - protein, 107 aa, Homo sapiens
MTSVAHMSTFRPHICHLSKTSPHPLVTRKRASSPHVVIVLTSGLKGKASLRLRPHLPVIFHPIPLPRLLGLSSCSIPPFADFKPLPFFPPRPTLFPLKPNVGQVLAF

SEQ ID NO: 797690 - protein, 84 aa, Homo sapiens
MGHCEGGAVPVEAAGRQAEIWPGAAAMRQELGLEKAPGRQEQGLQRLFSSQSWACSCHREAEGGPGEFDLRKFWAYIGRHELDR

SEQ ID NO: 797691 - protein, 84 aa, Homo sapiens; identical to SEQ ID NO: 797690

SEQ ID NO: 797692 - protein, 171 aa, Homo sapiens [sequence omitted]

SEQ ID NO: 797693 - protein, 114 aa, Homo sapiens
VFLRLSGALLRIHLGASAHSCTDGRCLCSQIWAIVNSAAVNVAAQTSLGQTEDAIRILPPSFPLPFLQALKLRLHARTRGLPFPRQLLPNVPSQKPVPARPRCATPKPTANPAQ

SEQ ID NO: 797694 - protein, 136 aa, Homo sapiens
YVGKPFTLPVHFKGMKEVTLERNPTNASNVGKPSLVPLRFNIMKGLTLERNPMGVSNVGKPSDLPSTFEYMEGLTLVRNPMNVSNVGKHFIVSAPFIDMKGLTLEKNLMNVSIVGKPSLVPYILEYMKEFTLERNL

SEQ ID NO: 797695 - protein, 286 aa, Homo sapiens
RTCPDLLLSDGKASISMPREGGSTCTARCPDPGEHSSTWGEFEGFRESSAKSGQFSQSLELLEGPTEPQPPRTTSAPKECSSHQPCQGGPWVTGTSAVPPSEPILSYENILKCAFQEITVQQAAEDVSTIDHFLEISSEEKPGVERVHKLCNESRKLWRALQSIHTTSTSQRLWSESRCQENFFLVLGIDAAQKNLSGGQGHIMEDCDLKEPEGLLTVSSFCLQHCKALIQTKLSGPPGSKQGRLMTCSRFLKTPSCGGGQHITIPRKRMFTPRKLKLTLFNSDVC

SEQ ID NO: 797696 - protein, 117 aa, Homo sapiens
RTCPDLLLSDGKASISMPREGGSTCTARCPDPGEHSSTWGEFEGFRESSAKSGQFSQSLELLEGPTEPQPPRTTSAPKECSSHQPLACESLWWARGFPQLSAKENCALRRAEPRSQP

SEQ ID NO: 797697 - protein, 151 aa, Homo sapiens
RTCPDLLLSDGKASISMPREGGSTCTARCPDPGEHSSTWGEFEGFRESSAKSGQFSQSLELLEGPTEPQPPRTTSAPKECSSHQPCQGGPWVTGTSAVPPSEPILSYENILKCAFQEITVQQAAEDVSTIDHFLEISSEEKPGVERVHKLW

SEQ ID NO: 797698 - protein, 259 aa, Homo sapiens
RTCPDLLLSDGKASISMPREGGSTCTARCPDPGEHSSTWGEFEGFRESSAKSGQFSQSLELLEGPTEPQPPRTTSAPKECSSHQPCQGGPWVTGTSAVPPSEPILSYENILKCAFQEITVQQAAEDVSTIDHFLEISSEEKPGVERVHKLCNESRKLWRALQSIHTTSTSQRLWSESRCQENFFLVLGIDAAQKNLSGGQGHIMEDCDLKEPEGLLTVSSFCLQHCKALIQTKHQSNRAAQAFLIQQQCYFLTQGRCMG

SEQ ID NO: 797699 - protein, 235 aa, Homo sapiens
RTCPDLLLSDGKASISMPREGGSTCTARCPDPGEHSSTWGEFEGFRESSAKSGQFSQSLELLEGPTEPQPPRTTSAPKECSSHQPCQGGPWVTGTSAVPPSEPILSYENILKCAFQEITVQQAAEDVSTIDHFLEISSEEKPGVERVHKLCNESRKLWRALQSIHTTSTSQRLWSESRCQENFFLVLGIDAAQKNLSGGQGHIMEDCDLKEPEGLLTVSSFCLQHCKALIQTKRP

SEQ ID NO: 797700 - protein, 155 aa, Homo sapiens
RTCPDLLLSDGKASISMPREGGSTCTARCPDPGEHSSTWGEFEGFRESSAKSGQFSQSLELLEGPTEPQPPRTTSAPKECSSHQPCQGGPWVTGTSAVPPSEPILSYENILKCAFQEITVQQAAEKRRGVYALKGSPEFSGFVTQFMYTFNARFF

SEQ ID NO: 797701 - protein, 156 aa, Homo sapiens
MTGCRGPGGTHGPPAPCECCWHLSSCAAANKGAARNAPPHRPHAHNPRGANRAPAAAPTKTAQAPPKRQEPPSTTRHPTPHHRAAHNHPSSHPAPKPTTAPAPPPTAPPSRAHGPTDPPPPAQHPHNTRPHHHPKRTRRPQRPAAPPGRPTHHPHP

SEQ ID NO: 797702 - protein, 370 aa, Homo sapiens
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 797703 - protein, 406 aa, Homo sapiens
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGVRSGLCRRAWVVHKGAPGLEWRACPAATSVLSSHAGPAAGCCCRDCCVEPGTELSPTLPHQL

SEQ ID NO: 797704 - protein, 431 aa, Homo sapiens
MPLHHLYTTAALCLERCKASVGRIWMRRCQHQRRTGTAGHTRLQQPRGQRRALAVVGGQWAMLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 797705 - protein, 328 aa, Homo sapiens
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKSFLPSPFNAFNASKPSMPRLWCGT

SEQ ID NO: 797706 - protein, 420 aa, Homo sapiens
KTQTDRTKTRNRMRDQRSKDSAPTTVSLPDQSPASGAVARALAVVGGQWAMLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 797707 - protein, 326 aa, Homo sapiens
MLGAVEGPRWKQAEDIRDIYDFRDVLGTIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 797708 - protein, 275 aa, Homo sapiens
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPW

SEQ ID NO: 797709 - protein, 114 aa, Homo sapiens [sequence omitted]

SEQ ID NO: 797710 - protein, 144 aa, Homo sapiens [sequence omitted]

SEQ ID NO: 797711 - protein, 125 aa, Homo sapiens
MPLHHLYTTAALCLERCKAVSAESGCGGASTSVGRAQLGTRGSSSRGGSAEPWLWSGGSGPCWGQWKAPGGSRRRTLETSTTSEMFWARSPQVVAKMIAISSRLTSYQLNRRLILKVLVSWLAIT

SEQ ID NO: 797712 - protein, 370 aa, Homo sapiens; identical to SEQ ID NO: 797702

SEQ ID NO: 797713 - protein, 275 aa, Homo sapiens; identical to SEQ ID NO: 797708

SEQ ID NO: 797714 - protein, 370 aa, Homo sapiens; identical to SEQ ID NO: 797702

SEQ ID NO: 797715 - protein, 308 aa, Homo sapiens
MENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 797716 - protein, 95 aa, Homo sapiens
GGRREPPSRAEPQLQQERGRVAQARSGEDRGHSSAPTTAGLPASPAAGQPQEPWLWSGGSGPCWGQWKAPGGSRRRTLETSTTSEMFWARGPSRR

SEQ ID NO: 797717 - protein, 353 aa, Homo sapiens
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIMISDFGLSKMEDPGSVLSTACGTLGGRQLAVAVETAAWSRAQNCPPHCPTSSRALDLGS

SEQ ID NO: 797718 - protein, 188 aa, Homo sapiens
MIELQDIHGLRMADEDMDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 797719 - protein, 211 aa, Homo sapiens
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYIL

SEQ ID NO: 797720 - protein, 764 aa, Homo sapiens
MEESSSVAMLVPDIGEQEAILTAESIISPSLEIDEQRKTKPDPLIHVIQKLSKIVENEKSQKCLLIGKKRPRSSAATHSLETQELCEIPAKVIQSPAADTRRAEMSQTNFTPDTLAQNEGKAMSYQCSLCKFLSSSFSVLKDHIKQHGQQNEVILMCSECHITSRSQEELEAHVVNDHDNDANIHTQSKAQQCVSPSSSLCRKTTERNETIPDIPVSVDNLQTHTVQTASVAEMGRRKWYAYEQYGMYRCLFCSYTCGQQRMLKTHAWKHAGEVDCSYPIFENENEPLGLLDSSAAAAPGGVDAVVIAIGESELSIHNGPSVQVQICSSEQLSSSSPLEQSAERGVHLSQSVTLDPNEEEMLEVISDAEENLIPDSLLTSAQKIISSSPNKKGHVNVIVERLPSAEETLSQKRFLMNTEMEEGKDLSLTEAQIGREGMDDVYRADKCTVDIGGLIIGWSSSEKKDELMNKGLATDENAPPGRRRTNSESLRLHSLAAEALVTMPIRAAELTRANLGHYGDINLLDPDTSQRQVDSTLAAYSKMMSPLKNSSDGLTSLNQSNSTLVALPEGRQELSDGQVKTGISMSLLTVIEKLRERTDQNASDDDILKELQDNAQCQPNSDTSLSGNNVVEYIPNAERPYRCRLCHYTSGNKGYIKQHLRVHRQRQPYQCPICEHIADNSKDLESHMIHHCKTRIYQCKQCEESFHYKSQLRNHEREQHSLPDTLSIATSNEPRISSDTADGKCVQEGIYVFCYAGCSDLHMT

SEQ ID NO: 797721 - protein, 756 aa, Homo sapiens
MEESSSVAMLVPDIGEQEAILTAESIISPSLEIDEQRKTKPDPLIHVIQKLSKIVENEKSQKCLLIGKKRPRSSAATHSLETQELCEIPAKVIQSPAADTRRAEMSQTNFTPDTLAQNEGKAMSYQCSLCKFLSSSFSVLKDHIKQHGQQNEVILMCSECHITSRSQEELEAHVVNDHDNDANIHTQSKAQQCVSPSSSLCRKTTERNETIPDIPVSVDNLQTHTVQTASVAEMGRRKWYAYEQYGMYRCLFCSYTCGQQRMLKTHAWKHAGEVDCSYPIFENENEPLGLLDSSAAAAPGGVDAVVIAIGESELSIHNGPSVQVQICSSEQLSSSSPLEQSAERGVHLSQSVTLDPNEEEMLEVISDAEENLIPDSLLTSAQKIISSSPNKKGHVNVIVERLPSAEETLSQKRFLMNTEMEEGKDLSLTEAQIGREGMDDVYRADKCTVDIGGLIIGWSSSEKKDELMNKGLATDENAPPGRRRTNSESLRLHSLAAEALVTMPIRAAELTRANLGHYGDINLLDPDTSQRQVDSTLAAYSKMMSPLKNSSDGLTSLNQSNSTLVALPEGRQELSDGQVKTGISMSLLTVIEKLRERTDQNASDDDILKELQDNAQCQPNSDTSLSGNNVVEYIPNAERPYRCRLCHYTSGNKGYIKQHLRVHRQRQPYQCPICEHIADNSKDLESHMIHHCKTRIYQCKQCEESFHYKSQLRNHEREQHSLPDTLSIATSNEPRISSDTLYVNGSGRYKYLYAAE

SEQ ID NO: 797722 - protein, 786 aa, Homo sapiens
MEESSSVAMLVPDIGEQEAILTAESIISPSLEIDEQRKTKPDPLIHVIQKLSKIVENEKSQKCLLIGKKRPRSSAATHSLETQELCEIPAKVIQSPAADTRRAEMSQTNFTPDTLAQNEGKAMSYQCSLCKFLSSSFSVLKDHIKQHGQQNEVILMCSECHITSRSQEELEAHVVNDHDNDANIHTQSKAQQCVSPSSSLCRKTTERNETIPDIPVSVDNLQTHTVQTASVAEMGRRKWYAYEQYGMYRCLFCSYTCGQQRMLKTHAWKHAGEVDCSYPIFENENEPLGLLDSSAAAAPGGVDAVVIAIGESELSIHNGPSVQVQICSSEQLSSSSPLEQSAERGVHLSQSVTLDPNEEEMLEVISDAEENLIPDSLLTSAQKIISSSPNKKGHVNVIVERLPSAEETLSQKRFLMNTEMEEGKDLSLTEAQIGREGMDDVYRADKCTVDIGGLIIGWSSSEKKDELMNKGLATDENAPPGRRRTNSESLRLHSLAAEALVTMPIRAAELTRANLGHYGDINLLDPDTSQRQVDSTLAAYSKMMSPLKNSSDGLTSLNQSNSTLVALPEGRQELSDGQVKTGISMSLLTVIEKLRERTDQNASDDDILKELQDNAQCQPNSDTSLSGNNVVEYIPNAERPYRCRLCHYTSGNKGYIKQHLRVHRQRQPYQCPICEHIADNSKDLESHMIHHCKTRIYQCKQCEESFHYKSQLRNHEREQHSLPDTLSIATSNEPRISSDTADGKCVQEGNKSSVQKQYRCDVCDYTSTTYVGVRNHRRIHNSDKPY

SEQ ID NO: 797723 - protein, 156 aa, Homo sapiens [sequence omitted]

SEQ ID NO: 797724 - protein, 270 aa, Homo sapiens
GDIDYSTVLLGMLVTQDVQLGLFMAVMPTLIQAGASTSSSIVVEVLRILVLIGQILFSLAAVFLLCLVIKKYLIGPYYRKLHMESKGNKEILILGISAFIFLMLTVVTELLDVSMELGCFLAGALVSSQGPVVTEEIATSIEPIRDFLAIVFFASIGLHVFPTFVAYELTVLVFLTLSVVVMKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 797725 - protein, 127 aa, Homo sapiens
GDIDYSTVLLGMLVTQDVQLGLFMAVMPTLIQAGASTSSSIVVEVLRILVLIGQILFSLAAVFLLCLVIKKYLIGPYYRKLHMESKGNKEILILGISAFIFLMLTVSCNHEVCAQTGETVQPLMARR

SEQ ID NO: 797726 - protein, 176 aa, Homo sapiens
PVTCGRRRRARRPAAPPPSPARLGRRGGGGGGPGGGGGARLAASLLPREAQGPLSRAAAPRPVSSLWWGMAAQPPACPRKGHTSQLFCHESTPNKGDRVIYNLTRLPYCCVWFPLPGIGPEILYLSQLASNLELSKRDKSRGEQRKEAVTCGMLRKASGPRPGFPSAPLARRPSDF

SEQ ID NO: 797727 - protein, 176 aa, Homo sapiens; identical to SEQ ID NO: 797726

SEQ ID NO: 797728 - protein, 198 aa, Homo sapiens
MNLDSLSLALSQISYLVDNLTKKNYRASQQEIQHIVNRHGPEADRHLLRCLFSHVDFSGDGKSSGKDFHQTQFLIQECALLITKPNFISTLSYAIDNPLHYQKSLKPAPHLFAQLSKVLKLSKVQEVIFGLALLNSSSSDLRGFAAQFIKQKLPDLLRSYIDADVSGNQEGGFQDIAIEVLHLLLSHLLFGQKGAFGV

SEQ ID NO: 797729 - protein, 198 aa, Homo sapiens; identical to SEQ ID NO: 797728

SEQ ID NO: 797730 - protein, 198 aa, Homo sapiens; identical to SEQ ID NO: 797728

SEQ ID NO: 797731 - protein, 138 aa, Homo sapiens
GPFQWQLCQGAYESLLAFTWSARNQTLGTSHEADKPGRHSVRITRNTTRPVREERVESRECFPHSADKERPLSHLLLQLWRQSSPTCHIEHKDQSAEKEHPNLIQWTLGKNSPQLSVEKQGQHTHLCTDTSPIKKLKC

SEQ ID NO: 797732 - protein, 156 aa, Homo sapiens
MCSCPGIASTGGAGNSLKVPHLGLDLVQRSISEDTGRSHNGSEDPSDQRVHEFVGAVHSVPAAQGCQDKETSCLVPALLQHGACGAPVSPGVPAQSPNPVEESPVLGFGEVWPWINFTLMVSMGHRTTTASATLAHWPHRCPPCCSPVPGHPASGC

SEQ ID NO: 797733 - protein, 147 aa, Homo sapiens
MCSAFVHLQVPHLGLDLVQRSISEDTGRSHNGSEDPSDQRVHEFVGAVHSVPAAQGCQDKETSCLVPALLQHGACGAPVSPGVPAQSPNPVEESPVLGFGEVWPWINFTLMVSMGHRTTTASATLAHWPHRCPPCCSPVPGHPASGC

SEQ ID NO: 797734 - protein, 156 aa, Homo sapiens; identical to SEQ ID NO: 797732

SEQ ID NO: 797735 - protein, 213 aa, Homo sapiens
MIQGQAQSSCKNLKQMVSTKHFTKKYSSCSTIYLDDSTASQPHLTIIVKSNELERQFLQLIDYNVEVSGSVYAKYYFDLRSLAKDNSLHFPVYLLNKERAQNLEAISRMEDAKIFYSEGPSALIISLIFSALKPLTLEGRNEGLYHVNPSSKKFGKYYLSCSTTRKVSIFKRRKISKLRGLWATRIALHRKKMGSLQCNNSRTLFCLFKRKQV

SEQ ID NO: 797736 - protein, 152 aa, Homo sapiens
AESQLIIYARLCFWALYCITFYFLSCQYHIVFYCSFVLSFEIRKCESSNFVLFQDCFGYLGSLAIPYEVQDSPFFLFFFEAGSHSVTQAGVPWHKLSSLQLRPHGLKRPFHLSFLSSWDYRFVAPRPVKGFSICTKNTIKILIGIESVDNFG

SEQ ID NO: 797737 - protein, 709 aa, Homo sapiens [sequence omitted]

SEQ ID NO: 797738 - protein, 709 aa, Homo sapiens [sequence omitted]

SEQ ID NO: 797739 - protein, 262 aa, Homo sapiens
GCTPGVRDQQVLNVVNNIFHGQLLSQVTCLACDNKSNTIEPFWDLSLEFPERYQCSGKDIASQPCLVTEMLAKFTETEALEGKIYVCDQCNSKRRRFSSKPVVLTEAQKQLMICHLPQVLRLHLKRFRWSGRNNREKIGVHVGFEEILNMEPYCCRETLKSLRPECFIYDLSAVVMHHGKGFGSGHYTAYCYNSEGGFWVHCNDSKLSMCTMDEVCKAQAYILFYTQRVTENGHSKLLPPELLLGSQHPNEDADTSSNEILS

SEQ ID NO: 797740 - protein, 709 aa, Homo sapiens [sequence omitted]

SEQ ID NO: 797741 - protein, 709 aa, Homo sapiens [sequence omitted]

SEQ ID NO: 797742 - protein, 111 aa, Homo sapiens
MCTTPACVQTHCACSPPRRWQATHCACSPPRCWQATHCACSPPRCWQATAQVWTAYTKGRVRGEGTQDSGSMPAYKTVSQRSDCPVGDLSSRPLGLFQVYFTSFHSCSKTF

SEQ ID NO: 797743 - protein, 101 aa, Homo sapiens
LLRRLRQENHLSAGGGGCSEPRSRHCTLAWVTERDSVSKKKERKKKEVNEGTRVYLMVSINCNNIKNLMAENHSLTRKSKWLQKTLPMDLCFEKRNFQTCE

SEQ ID NO: 797744 - protein, 305 aa, Homo sapiens
MRGNLALVGVLISLAFLSLLPSGHPQPAGDDACSVQILVPGLKGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGWPVSSSASTTWRRRAPSCTLTTPPCGPSTSGAAVSPTMPTTRRTAWRWWPRAAGTTWPATPPCTSCVSLTRRTCEPQAGAAHWGPHMSLQGWQGQSPDHGASQGAVPL

SEQ ID NO: 797745 - protein, 305 aa, Homo sapiens; identical to SEQ ID NO: 797744

SEQ ID NO: 797746 - protein, 281 aa, Homo sapiens
MRGNLALVGVLISLAFLSLLPSGHPQPAGDDACSVQILVPGLKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGWPVSSSASTTWRRRAPSCTLTTPPCGPSTSGAAVSPTMPTTRRTAWRWWPRAAGTTWPATPPCTSCVSLTRRTCEPQAGAAHWGPHMSLQGWQGQSPDHGASQGAVPL

SEQ ID NO: 797747 - protein, 279 aa, Homo sapiens
MWWVPPSPYGCLPCALPGDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGWPVSSSASTTWRRRAPSCTLTTPPCGPSTSGAAVSPTMPTTRRTAWRWWPRAAGTTWPATPPCTSCVSLTRRTCEPQAGAAHWGPHMSLQGWQGQSPDHGASQGAVPL

SEQ ID NO: 797748 - protein, 88 aa, Homo sapiens
VTGCPAVAVPITVYSFLCVGVGVLPALRMRGNLALVGVLISLAFLSLLPSGHPQPAGDDACSVQILVPGLKGNRSLDSGLLGSGLRAS

SEQ ID NO: 797749 - protein, 302 aa, Homo sapiens
MTPALCRSSSLASKGMRERRETKAPPDGLEESAPREKKQSQPVVTASDISKRKCTSSFVEMGSQGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGWPVSSSASTTWRRRAPSCTLTTPPCGPSTSGAAVSPTMPTTRRTAWRWWPRAAGTTWPATPPCTSCVSLTRRTCEPQAGAAHWGPHMSLQGWQGQSPDHGASQGAVPL

SEQ ID NO: 797750 - protein, 305 aa, Homo sapiens; identical to SEQ ID NO: 797744

SEQ ID NO: 797751 - protein, 281 aa, Homo sapiens
MGEKVPEAAVSEASRAASSRDAGEKGDKGAPGRPGRVGPTGEKGDMGDKGQKGSVGRHGKIGPIGSKGEKGDSGDIGPPGPNGEPGLPCECSQLRKAIGEMDNQVSQLTSELKFIKNAVAGVRETESKIYLLVKEEKRYADAQLSCQGRGGTLSMPKDEAANGLMAAYLAQAGWPVSSSASTTWRRRAPSCTLTTPPCGPSTSGAAVSPTMPTTRRTAWRWWPRAAGTTWPATPPCTSCVSLTRRTCEPQAGAAHWGPHMSLQGWQGQSPDHGASQGAVPL

SEQ ID NO: 797752 - protein, 108 aa, Homo sapiens
KFNLDLTHPVEDGIFDSGNFEQFLREKVKVNGKTGNLGNVVHIERFKNKITVVSEKQFSKRYLKYLTKKYLKKNNLRDWLRVVASDKETYELRYFQISQDEDESESED

SEQ ID NO: 797753 - protein, 155 aa, Homo sapiens
MLIPKTMGKMSPGHVRDLHGSPSHHRPRGPGGKSGFVGWAQGLCAVCSLGTWCPVSQLLQPWLKGANIELGLWLQRVEAPSIGSFHVMLSLWVQRCQELRFGNLCLDFRIYMETPGCPGKSLLQGQSPHGEPLLGQCGREMWGRAPTQSPCWGTA

SEQ ID NO: 797754 - protein, 159 aa, Homo sapiens
CSHPPSLKSHMWKHASDQNYNYEQVNKAINDAISQSGRVLGKSPGKTQLKSSEESADPVTGSSENAVSSSELMSQTPSEVLGTNENEKLSPTSNTSYSLEKISSLAPPSMEYCVLLFCCCICGFESTSKENLLDHMKEHEGEIVNIILNKDHNTALNTN

SEQ ID NO: 797755 - protein, 601 aa, Homo sapiens [sequence omitted]

SEQ ID NO: 797756 - protein, 601 aa, Homo sapiens [sequence omitted]

SEQ ID NO: 797757 - protein, 574 aa, Homo sapiens
MKRYINQLTVAKKQCEKRIRILGGPAYDQQEDGALDEGEGPQSQKILQFEDILANTFYREHFGMYMERMDKRALISFWESVEHLKNANKNEIPQLVGEIYQNFFVESKEISVEKSLYKEIQQCLVGNKGIEVFYKIQEDVYETLKDRYYPSFIVSDLYEKLLIKEEEKHASQMISNKDEMGPRDEAGEEAVDDGTNQINEQASFAVNKLRELNEKLEYKRIVSKLKDEIILIEKERTDLQLHMARTDWWCENLGMWKASITSGEVTEENGEQLPCYFVMVSLQEVGGVETKNWTVPRRLSEFQNLHRKLSECVPSLKKVQLPSLSKLPFKSIDQKFMEKSKNQLNKFLQNLLSDERLCQSEALYAFLSPSPDYLKVIDVQGKKNSFSLSSFLERLPRDFFSHQEEETEEDSDLSDYGDDVDGRKDALAEPCFMLIGEIFELRGMFKWVRRTLIALVQVTFGRTINKQIRDTVSWIFSEQMLVYYINIFRDAFWPNGKLAPPTTIRSKEQSQETKQRAQQKLLENIPDMLQSLVGQQNARHGIIKIFNALQETRANKHLLYGTSTNTLLSPRDHD

SEQ ID NO: 797758 - protein, 586 aa, Homo sapiens
MKRYINQLTVAKKQCEKRIRILGGPAYDQQEDGALDEGEGPQSQKILQFEDILANTFYREHFGMYMERMDKRALISFWESVEHLKNANKNEIPQLVGEIYQNFFVESKEISVEKSLYKEIQQCLVGNKGIEVFYKIQEDVYETLKDRYYPSFIVSDLYEKLLIKEEEKHASQMISNKDEMGPRDEAGEEAVDDGTNQINEQASFAVNKLRELNEKLEYKRIVSKLKDEIILIEKERTDLQLHMARTDWWCENLGMWKASITSGEVTEENGEQLPCYFVMVSLQEVGGVETKNWTVPRRLSEFQNLHRKLSECVPSLKKVQLPSLSKLPFKSIDQKFMEKSKNQLNKFLQNLLSDERLCQSEALYAFLSPSPDYLKVIDVQGKKNSFSLSSFLERLPRDFFSHQEEETEEDSDLSDYGDDVDGRKDALAEPCFMLIGEIFELRGMFKWVRRTLIALVQVTFGRTINKQIRDTVSWIFSEQMLVYYINIFRDAFWPNGKLAPPTTIRSKEQSQETKQRAQQKLLENIPDMLQSLVGQQNARHGIIKIFNALQETRANKHLLYALMELLLIELCPELRVHLDQLKAGQV

SEQ ID NO: 797759 - protein, 1094 aa, Homo sapiens
VLFTYHGNSGLLATKSDETGWTTFFDYDSEGRLTNVTFPTGVVTNLHGDMDKAITVDIESSSREEDVSITSNLSSIDSFYTMVQDQLRNSYQIGYDGSLRIIYASGLDSHYQTEPHVLAGTANPTVAKRNMTLPGENGQNLVEWRFRKEQAQGKVNVFGRKLRVNGRNLLSVDFDRTTKTEKIYDDHRKFLLRIAYDTSGHPTLWLPSSKLMAVNVTYSSTGQIASIQRGTTSEKVDYDGQGRIVSRVFADGKTWSYTYLEKSMVLLLHSQRQYIFEYDMWDRLSAITMPSVARHTMQTIRSIGYYRNIYNPPESNASIITDYNEEGLLLQTAFLGTSRRVLFKYRRQTRLSEILYDSTRVSFTYDETAGVLKTVNLQSDGFICTIRYRQIGPLIDRQIFRFSEDGMVNARFDYSYDNSFRVTSMQGVINETPLPIDLYQFDDISGKVEQFGKFGVIYYDINQIISTAVMTYTKHFDAHGRIKEIQYEIFRSLMYWITIQYDNMGRVTKREIKIGPFANTTKYAYEYDVDGQLQTVYLNEKIMWRYNYDLNGNLHLLNPSNSARLTPLRYDLRDRITRLGDVQYRLDEDGFLRQRGTEIFEYSSKGLLTRVYSKGSGWTVIYRYDGLGRRVSSKTSLGQHLQFFYADLTYPTRITHVYNHSSSEITSLYYDLQGHLFAMEISSGDEFYIASDNTGTPLAVFSSNGLMLKQIQYTAYGEIYFDSNIDFQLVIGFHGGLYDPLTKLIHFGERDYDILAGRWTTPDIEIWKRIGKDPAPFNLYMFRNNNPASKIHDVKDYITDVNSWLVTFGFHLHNAIPGFPVPKFDLTEPSYELVKSQQWDDIPPIFGVQQQVARQAKAFLSLGKMAEVQVSRRRAGGAQSWLWFATVKSLIGKGVMLAVSQGRVQTNVLNIANEDCIKVAAVLNNAFYLENLHFTIEGKDTHYFIKTTTPESDLGTLRLTSGRKALENGINVTVSQSTTVVNGRTRRFADVEMQFGALALHVRYGMTLDEEKARILEQARQRALARAWAREQQRVRDGEEGARLWTEGEKRQLLSAGKVQGYDGYYVLSVEQYPELADSANNIQFLRQSEIGRR

SEQ ID NO: 797760 - protein, 221 aa, Homo sapiens
MEGSFHQKTPRHKQPTLLMVRASRRSGKTSAVLKAGRQSVSGRKNSTSKDLVTLGASSLREERGHPLHPRHRKAPPAHQGQDTWLGADAGPDVAEDSRAGRGAAAAAAAAAGGDAGHAPFPPPPAADGARAPRSPGQVTPRGLRLRLPRRESLLRGLCRPLRPLLGFRESDSAKPASLRLLQHTPSARRNYRIAGARLMRSNYPPPLSSAALRGAGPTRRN

SEQ ID NO: 797761 - protein, 359 aa, Homo sapiens
MAEHGAHFTAASVADDQPSIFEVVAQDSLMTAVRPALQHVVKVLAESNPTHYGFLWRWFDEIFTLLDLLLQQHYLSRTSASFSENFYGLKRIVMGDTHKSQRLASAGLPKQQLWKSIMFLVLLPYLKVKLEKLVSSLREEDEYSIHPPSSRWKRFYRAFLAAYPFVNMAWEGWFLVQQLRYILGKAQHHSPLLRLAGVQLGRLTVQDIQALEHKPAKASMMQQPARSVSEKINSALKKAVGGVALSLSTGLSVGVFFLQFLDWWYSSENQETIKSLTALPTPPPPVHLDYNSDSPLLPKMKTVCPLCRKTRVNDTVLATSGYVFCYRCVFHYVRSHQACPITGYPTEVQHLIKLYSPEN

SEQ ID NO: 797762 - protein, 359 aa, Homo sapiens; identical to SEQ ID NO: 797761

SEQ ID NO: 797763 - protein, 104 aa, Homo sapiens
TRRSSSSEEDDALRHHDDLPSNVASWVVCASPGVSEQGRARAGILKANSWSQPSCPGLTVARLNPQSRLAFELSRLGRRGRFWFAAPEDCVPSPIPVPHSHALP

SEQ ID NO: 797764 - protein, 100 aa, Homo sapiens
MPTGTMLGAGWALRVRLDPFLKEGRGVCSCTPWWVLTISPAHSLLGQPHSDPLSPRNGLDLPLGVFCLGPGFPNTGWCHPSLLQGQQICKPQVSPISLEK

SEQ ID NO: 797765 - protein, 917 aa, Homo sapiens
MFAVHLMAFYFSKLKEDQIKKVDRFLYHMRLSDDTLLDIMRRFRAEMEKGLAKGTNPTAAVKMLPTFVRAIPDGSENGEFLSLDLGGSKFRVLKVQVAEEGKRHVQMESQFYPTPNEIIRGNGTELFEYVADCLADFMKTKDLKHKKLPLGLTFSFPCRQTKLEEGVLLSWTKKFKARGVQDTDVVSRLTKAMRRHKDMDVDILALVNDTVGTMMTCAYDDPYCEVGVIIGTGTNACYMEDMSNIDLVEGDEGRMCINTEWGAFGDDGALEDIRTEFDRELDLGSLNPGKQLFEKMISGLYLGELVRLILLKMAKAGLLFGGEKSSALHTKGKIETRHVAAMEKYKEGLANTREILVDLGLEPSEADCIAVQHVCTIVSFRSANLCAAALAAILTRLRENKKVERLRTTVGMDGTLYKIHPQYPKRLHKVVRKLVPSCDVRFLLSESGSTKGAAMVTAVASRVQAQRKQIDRVLALFQLTREQLVDVQAKMRAELEYGLKKKSHGLATVRMLPTYVCGLPDGTEKGKFLALDLGGTNFRVLLVKIRSGRRSVRMYNKIFAIPLEIMQGTGEELFDHIVQCIADFLDYMGLKGASLPLGFTFSFPCRQMSIDKGTLIGWTKGFKATDCEGEDVVDMLREAIKRRNEFDLDIVAVVNDTVGTMMTCGYEDPNCEIGLIAGTGSNMCYMEDMRNIEMVEGGEGKMCINTEWGGFGDNGCIDDIRTRYDTEVDEGSLNPGKQRYEKMTSGMYLGEIVRQILIDLTKQGLLFRGQISERLRTRGIFETKFLSQIESDRLALLQVRRILQQLGLDSTCEDSIVVKEVCGAVSRRAAQLCGAGLAAIVEKRREDQGLEHLRITVGVDGTLYKLHPHFSRILQETVKELAPRCDVTFMLSEDGSGKGAALITAVAKRLQQAQKEN

SEQ ID NO: 797766 - protein, 724 aa, Homo sapiens
MFAVHLMAFYFSKLKEDQIKKVDRFLYHMRLSDDTLLDIMRRFRAEMEKGLAKGTNPTAAVKMLPTFVRAIPDGSENGEFLSLDLGGSKFRVLKVQVAEEGKRHVQMESQFYPTPNEIIRGNGTELFEYVADCLADFMKTKDLKHKKLPLGLTFSFPCRQTKLEEGVLLSWTKKFKARGVQDTDVVSRLTKAMRRHKDMDVDILALVNDTVGTMMTCAYDDPYCEVGVIIGTGTNACYMEDMSNIDLVEGDEGRMCINTEWGAFGDDGALEDIRTEFDRELDLGSLNPGKQLFEKMISGLYLGELVRLILLKMAKAGLLFGGEKSSALHTKGKIETRHVAAMEKYKEGLANTREILVDLGLEPSEADCIAVQHVCTIVSFRSANLCAAALAAILTRLRENKKVERLRTTVGMDGTLYKIHPQYPKRLHKVVRKLVPSCDVRFLLSESGSTKGAAMVTAVASRVQAQRKQIDRVLALFQLTREQLVDVQAKMRAELEYGLKKKSHGLATVRMLPTYVCGLPDGTEKGKFLALDLGGTNFRVLLVKIRSGRRSVRMYNKIFAIPLEIMQGTGEELFDHIVQCIADFLDYMGLKGASLPLGFTFSFPCRQMSIDKGTLIGWTKGFKATDCEGEDVVDMLREAIKRRNEFDLDIVAVVNDTVGTMMTCGYEDPNCEIGLIAGTGSNMCYMEDMRNIEMVEGGEEEDVHLFFILPVVCVAAVDSCFKDC

SEQ ID NO: 797767 - protein, 791 aa, Homo sapiens
MFAVHLMAFYFSKLKEDQIKKVDRFLYHMRLSDDTLLDIMRRFRAEMEKGLAKGTNPTAAVKMLPTFVRAIPDGSENGEFLSLDLGGSKFRVLKVQVAEEGKRHVQMESQFYPTPNEIIRGNGTELFEYVADCLADFMKTKDLKHKKLPLGLTFSFPCRQTKLEEGVLLSWTKKFKARGVQDTDVVSRLTKAMRRHKDMDVDILALVNDTVGTMMTCAYDDPYCEVGVIIGTGTNACYMEDMSNIDLVEGDEGRMCINTEWGAFGDDGALEDIRTEFDRELDLGSLNPGKQLFEKMISGLYLGELVRLILLKMAKAGLLFGGEKSSALHTKGKIETRHVAAMEKYKEGLANTREILVDLGLEPSEADCIAVQHVCTIVSFRSANLCAAALAAILTRLRENKKVERLRTTVGMDGTLYKIHPQYPKRLHKVVRKLVPSCDVRFLLSESGSTKGAAMVTAVASRVQAQRKQIDRVLALFQLTREQLVDVQAKMRAELEYGLKKKSHGLATVRMLPTYVCGLPDGTEKGKFLALDLGGTNFRVLLVKIRSGRRSVRMYNKIFAIPLEIMQGTGEELFDHIVQCIADFLDYMGLKGASLPLGFTFSFPCRQMSIDKGTLIGWTKGFKATDCEGEDVVDMLREAIKRRNEFDLDIVAVVNDTVGTMMTCGYEDPNCEIGLIAGTGSNMCYMEDMRNIEMVEGGEGKMCINTEWGGFGDNGCIDDIRTRYDTEVDEGSLNPGKQRYEKMTSGMYLGEIVRQILIDLTKQGLLFRGQISERLRTRGIFETKFLSQIER

SEQ ID NO: 797768 - protein, 204 aa, Homo sapiens
GPADSLSILGQELGFGRCPWSGDGSEICPRKRRPYLGEIVRQILIDLTKQGLLFRGQISERLRTRGIFETKFLSQIESDRLALLQVRRILQQLGLDSTCEDSIVVKEVCGAVSRRAAQLCGAGLAAIVEKRREDQGLEHLRITVGVDGTLYKLHPHFSRILQETVKELAPRCDVTFMLSEDGSGKGAALITAVAKRLQQAQKEN

SEQ ID NO: 797769 - protein, 551 aa, Homo sapiens
MFAVHLMAFYFSKLKEDQIKKVDRFLYHMRLSDDTLLDIMRRFRAEMEKGLAKGTNPTAAVKMLPTFVRAIPDGSENGEFLSLDLGGSKFRVLKVQVAEEGKRHVQMESQFYPTPNEIIRGNGTELFEYVADCLADFMKTKDLKHKKLPLGLTFSFPCRQTKLEEGVLLSWTKKFKARGVQDTDVVSRLTKAMRRHKDMDVDILALVNDTVGTMMTCAYDDPYCEVGVIIGTGTNACYMEDMSNIDLVEGDEGRMCINTEWGAFGDDGALEDIRTEFDRELDLGSLNPGKQLFEKMISGLYLGELVRLILLKMAKAGLLFGGEKSSALHTKGKIETRHVAAMEKYKEGLANTREILVDLGLEPSEADCIAVQHVCTIVSFRSANLCAAALAAILTRLRENKKVERLRTTVGMDGTLYKIHPQYPKRLHKVVRKLVPSCDVRFLLSESGSTKGAAMVTAVASRVQAQRKQIDRVLALFQLTREQLVDVQAKMRAELEYGLKKKSHGLATVRMLPTYVCGLPDGTGGPAQPPSLNSHPGLPSKLLKASEVLGF

SEQ ID NO: 797770 - protein, 67 aa, Homo sapiens
SALATGSARSGVGGKAAAGLIKDPIKRPAEGRDLVSSGVWRWSYYYVRYSAAERRNVMTTEQQVPWS

SEQ ID NO: 797771 - protein, 80 aa, Homo sapiens
SALATGSARSGVGGKAAAGLIKDPIKRPAEGRDLVSSGVWRWSYYYVRYSAVRSRPFYRKFKTFKMCISFLQSVTTGASP

SEQ ID NO: 797772 - protein, 91 aa, Homo sapiens
GYGKINKKRIALIHNTLIARSLGKYGIICLEDLIHEIYTVGKCFKEANNYLWPFKLSSPRGGMKKKTTHFVEGGDASNREDQINRLIRRMN

SEQ ID NO: 797773 - protein, 125 aa, Homo sapiens [sequence omitted]

SEQ ID NO: 797774 - protein, 107 aa, Homo sapiens
MECCWVAQAGLEFLGSSDPPVSENWWVLGLTDFKNEAADPRESVSTSYSSRFMRQGLPAHLAGPKHLFNLLPPSCLAALLSSSSRVSKSWKQKHIYTHAHMYMPTVT

SEQ ID NO: 797775 - protein, 413 aa, Homo sapiens
LFWAEALDERRNYSRVQGLAPGVGGCFRVALPETGSCPSSSPGGSCPRGGRSPRGREPRMDFILEDMDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 797776 - protein, 347 aa, Homo sapiens
MDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 797777 - protein, 394 aa, Homo sapiens [sequence omitted]

SEQ ID NO: 797778 - protein, 347 aa, Homo sapiens; identical to SEQ ID NO: 797776

SEQ ID NO: 797779 - protein, 370 aa, Homo sapiens
ILRIPWKPPMVDTSLVMDFILEDMDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 797780 - protein, 413 aa, Homo sapiens; identical to SEQ ID NO: 797775

SEQ ID NO: 797781 - protein, 241 aa, Homo sapiens
MSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 797782 - protein, 291 aa, Homo sapiens
LFWAEALDERRNYSRVQGLAPGVGGCFRVALPETGSCPSSSPGGSCPRGGRSPRGREPRMDFILEDMDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFLSEL

SEQ ID NO: 797783 - protein, 111 aa, Homo sapiens
HLGPVLSELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 797784 - protein, 384 aa, Homo sapiens
LFWAEALDERRNYSRVQGLAPGVGGCFRVALPETGSCPSSSPGGSCPRGGRSPRGREPRMDFILEDMDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGM

SEQ ID NO: 797785 - protein, 347 aa, Homo sapiens; identical to SEQ ID NO: 797776

SEQ ID NO: 797786 - protein, 347 aa, Homo sapiens; identical to SEQ ID NO: 797776

SEQ ID NO: 797787 - protein, 347 aa, Homo sapiens; identical to SEQ ID NO: 797776

SEQ ID NO: 797788 - protein, 347 aa, Homo sapiens; identical to SEQ ID NO: 797776

SEQ ID NO: 797789 - protein, 342 aa, Homo sapiens
LFWAEALDERRNYSRVQGLAPGVGGCFRVALPETGSCPSSSPGGSCPRGGRSPRGREPRMDFILEDMDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKR

SEQ ID NO: 797790 - protein, 413 aa, Homo sapiens; identical to SEQ ID NO: 797775

SEQ ID NO: 797791 - protein, 109 aa, Homo sapiens [sequence omitted]

SEQ ID NO: 797792 - protein, 107 aa, Homo sapiens
PVSLEKPCMSHLLFLLDTSSAKCSKCPHSLPASLPSFPLFSRRGGLCCLQMTVDLIDRQLFFIVCFLLLLTKVHSLFYSMLKLLNGNGFSLTKEAFSSPLPCLSFLR

SEQ ID NO: 797793 - protein, 120 aa, Homo sapiens
MAAVAFKAEGQQSNAEVPAFVEPTSPTGACLSFLDCSKVAYQHLPRSLGLPFKTGFDLTDSHVAILLKEGGMGIESVKSAPSLRTQDLPRNKRLTQTGGKAVKHERTQKMFKGSSGEREK

SEQ ID NO: 797794 - protein, 120 aa, Homo sapiens; identical to SEQ ID NO: 797793

SEQ ID NO: 797795 - protein, 632 aa, Homo sapiens
CECGSLLDSSWDKQKNSCNAESLGTSMPSETGVSACVSFSPTSLCCDPSVYSLVTFPLQEGGPGVSPSHLVSSLLGSLLPQSTGGQLRRSYLKKGGVCQGAGWSLAIYLPSSGTLGTEMALMQELYSTPASRLDSFVAQWLQPHREWKEEVLDAVRTVEEFLRQEHFQGKRGLDQDVRVLKVVKVGSFGNGTVLRSTREVELVAFLSCFHSFQEAAKHHKDVLRLIWKTMWQSQDLLDLGLEDLRMEQRVPDALVFTIQTRGTAEPITVTIVPAYRALGPSLPNSQPPPEVYVSLIKACGGPGNFCPSFSELQRNFVKHRPTKLKSLLRLVKHWYQQYVKARSPRANLPPLYALELLTIYAWEMGTEEDENFMLDEGFTTVMDLLLEYEVICIYWTKYYTLHNAIIEDCVRKQLKKERPIILDPADPTLNVAEGYRWDIVAQRASQCLKQDCCYDNRENPISSWNVKRARDIHLTVEQRGYPDFNLIVNPYEPIRKVKEKIRRTRGYSGLQRLSFQVPGSERQLLSSRCSLAKYGIFSHTHIYLLETIPSEIQVFVKNPDGGSYAYAINPNSFILGLKQQIEDQQGLPKKQQQLEFQGQVLQDWLGLGIYGIQDSDTLILSKKKGEALFPAS

SEQ ID NO: 797796 - protein, 515 aa, Homo sapiens
CECGSLLDSSWDKQKNSCNAESLGTSMPSETGVSACVSFSPTSLCCDPSVYSLVTFPLQEGGPGVSPSHLVSSLLGSLLPQSTGGQLRRSYLKKGGVCQGAGWSLAIYLPSSGTLGTEMALMQELYSTPASRLDSFVAQWLQPHREWKEEVLDAVRTVEEFLRQEHFQGKRGLDQDVRVLKVVKVGSFGNGTVLRSTREVELVAFLSCFHSFQEAAKHHKDVLRLIWKTMWQSQDLLDLGLEDLRMEQRVPDALVFTIQTRGTAEPITVTIVPAYRALGPSLPNSQPPPEVYVSLIKACGGPGNFCPSFSELQRNFVKHRPTKLKSLLRLVKHWYQQYVKARSPRANLPPLYALELLTIYAWEMGTEEDENFMLDEGFTTVMDLLLEYEVICIYWTKYYTLHNAIIEDCVRKQLKKERPIILDPADPTLNVAEGTGWVWGSMASKTVTLSSSRRRKERLCFQPVSFLWETSLYISAMYSRTHPVNHSVPLSTGKVPGLHQFYNELSQARRGSSHL

SEQ ID NO: 797797 - protein, 113 aa, Homo sapiens
HTPPHLANFSIFNTGFHHVGQAGLKLLTSSDLPAWAFQSAGITGVNRHTWPQFPYELFHHQYLSGQQCLYLCMLSAMKNPLLKAGITGMSTRRHYLTFAMILYVGNMGSSVLP

SEQ ID NO: 797798 - protein, 189 aa, Homo sapiens
LLNDSLNLHRYSGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 797799 - protein, 394 aa, Homo sapiens
MVSAAGLSGDGKMRGVLLVLLGLLYSSTSCGVQKASVFYGPDPKEGLVSSMEFPWVVSLQDSQYTHLAFGCILSEFWVLSIASAIQNRKDIVVIVGISNMDPSKIAHTEYPVNTIIIHEDFDNNSMSNNIALLKTDTAMHFGNLVQSICFLGRMLHTPPVLQNCWVSGWNPIICRNHMTMGVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 797800 - protein, 259 aa, Homo sapiens [sequence omitted]

SEQ ID NO: 797801 - protein, 76 aa, Homo sapiens
MEFPWVVSLQDSQYTHLAFGCILSEFWVLSIASAIQNRPVPLPLGPATSPGVRVGATLFPAQPGEALKGAFWGDRA

SEQ ID NO: 797802 - protein, 394 aa, Homo sapiens; identical to SEQ ID NO: 797799

SEQ ID NO: 797803 - protein, 226 aa, Homo sapiens
MESHICRNHMTMGVLRKIFVKDLDMCPLYKLQKTECGSHTKEETKTACLGDPGSPMMCQLQQFDLWVLRGVLNFGGETCPGLFLYTKVEDYSKWITSKAERAGPPLSSLHHWEKLISFSHHGPNATMTQKTYSDSELGHVGSYLQGQRRTITHSRLGNSSRDSLDVREKDVKESGRSPEASVQPLYYDYYGGEVGEGRIFAGQNRLYQPEEIILVSFVLVFFCSSI

SEQ ID NO: 797804 - protein, 115 aa, Homo sapiens
MRGVLLVLLGLLYSSTSCGVQKASVFYGPDPKEGLVSSMEFPWVVSLQDSQYTHLAFGCILSEFWVLSIASAIQNRKVGFLQVRTGCISPKKSSWFPSCLFSFAAVSSPGATPPN

SEQ ID NO: 797805 - protein, 166 aa, Homo sapiens
GSWYAPGSEQLLLASFILQVPAIQTVLELQKLRPDLWPGPPQGLLSYSHCFCIRYFQLQLPTGWGTHFRQKVLVPSTDPTPRAATAACGFRMKGETPVNSTMSIGQARKMVEQLKIEASLCRIKVSKAAADLMTYCDAHACEDPLITPVPTSENPFREKKFFCALL

SEQ ID NO: 797806 - protein, 166 aa, Homo sapiens; identical to SEQ ID NO: 797805

SEQ ID NO: 797807 - protein, 166 aa, Homo sapiens; identical to SEQ ID NO: 797805

SEQ ID NO: 797808 - protein, 223 aa, Homo sapiens
MELLTKQGWSSAYSIESVIMQISATLVKGKARVQFGANKSQYSLTRAQQSYKSLVQIHEKNGWYTPPKKTVNLSGVYSRQVDRPEYEADLGTLGEYPKGLKEVPLGCQHFRKAQGPTPPRSKLHWLAGGRAGGGEDTVPCVPAPVPPSLAPGRQYVHADPASQSTFMEMNRLGWPALAGHMLARSRLQPRVVAARHAVLMAAHVAVSMQHGDAPRSEMTQEPP

SEQ ID NO: 797809 - protein, 401 aa, Homo sapiens
ASCAGSPWEHAAPSHVRGERRRRGVARKHARHTQTRTEAPTGACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKSQYSLTRAQQSYKSLVQIHEKNGWYTPPKEDG

SEQ ID NO: 797810 - protein, 474 aa, Homo sapiens
GGACPGGGGGAILAKGGSGSADRGGGGGGGGGGPERRPEVPARRPRSGGTRRMQQPQPQGQQQPGPGQQLGGQGAAPGAGGGPGGGPGPGPCLRRELKLLESIFHRGHERFRIASACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKSQYSLTRAQQSYKSLVQIHEKNGWYTPPKEDG

SEQ ID NO: 797811 - protein, 337 aa, Homo sapiens
GGACPGGGGGAILAKGGSGSADRGGGGGGGGGGPERRPEVPARRPRSGGTRRMQQPQPQGQQQPGPGQQLGGQGAAPGAGGGPGGGPGPGPCLRRELKLLESIFHRGHERFRIASACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGEFAPERGLHKSHP

SEQ ID NO: 797812 - protein, 351 aa, Homo sapiens
GGACPGGGGGAILAKGGSGSADRGGGGGGGGGGPERRPEVPARRPRSGGTRRMQQPQPQGQQQPGPGQQLGGQGAAPGAGGGPGGGPGPGPCLRRELKLLESIFHRGHERFRIASACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKAGAVPTP

SEQ ID NO: 797813 - protein, 105 aa, Homo sapiens [sequence omitted]

SEQ ID NO: 797814 - protein, 474 aa, Homo sapiens; identical to SEQ ID NO: 797810

SEQ ID NO: 797815 - protein, 474 aa, Homo sapiens; identical to SEQ ID NO: 797810

SEQ ID NO: 797816 - protein, 474 aa, Homo sapiens; identical to SEQ ID NO: 797810

SEQ ID NO: 797817 - protein, 626 aa, Homo sapiens
GGACPGGGGGAILAKGGSGSADRGGGGGGGGGGPERRPEVPARRPRSGGTRRMQQPQPQGQQQPGPGQQLGGQGAAPGAGGGPGGGPGPGPCLRRELKLLESIFHRGHERFRIASACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKSQYSLTRAQQSYKSLVQIHEKNGWYTPPKKTVNLSGVYSRQVDRPEYEADLGTLGEYPKGLKEVPLGCQHFRKAQGPTPPRSKLHWLAGGRAGGGEDTVPCVPAPVPPSLAPGRQYVHADPASQSTFMEMNRLGWPALAGHMLARSRLQPRVVAARHAVLMAAHVAVSMQHGDAPRSEMTQEPP

SEQ ID NO: 797818 - protein, 400 aa, Homo sapiens
GGACPGGGGGAILAKGGSGSADRGGGGGGGGGGPERRPEVPARRPRSGGTRRMQQPQPQGQQQPGPGQQLGGQGAAPGAGGGPGGGPGPGPCLRRELKLLESIFHRGHERFRIASACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKPLKREYIYSTEYCLSKQSLSVCPLIP

SEQ ID NO: 797819 - protein, 474 aa, Homo sapiens; identical to SEQ ID NO: 797810

SEQ ID NO: 797820 - protein, 330 aa, Homo sapiens
AVLEDPNFDGRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKSQYSLTRAQQSYKSLVQIHEKNGWYTPPKEDG

SEQ ID NO: 797821 - protein, 234 aa, Homo sapiens
LIRLRMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKSQYSLTRAQQSYKSLVQIHEKNGWYTPPKEDG

SEQ ID NO: 797822 - protein, 93 aa, Homo sapiens
FCQAQLTNLSHARYVLGGGAICMELLTKQGWSSAYSIESVIMQISATLVKGKARVQFGANKSQYSLTRAQQSYKSLVQIHEKNGWYTPPKEDG

SEQ ID NO: 797823 - protein, 105 aa, Homo sapiens [sequence omitted]

SEQ ID NO: 797824 - protein, 474 aa, Homo sapiens; identical to SEQ ID NO: 797810

SEQ ID NO: 797825 - protein, 462 aa, Homo sapiens
GGACPGGGGGAILAKGGSGSADRGGGGGGGGGGPERRPEVPARRPRSGGTRRMQQPQPQGQQQPGPGQQLGGQGAAPGAGGGPGGGPGPGPCLRRELKLLESIFHRGHERFRIASACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKVRILVLGLVGLGGAKYTWGH

SEQ ID NO: 797826 - protein, 301 aa, Homo sapiens
SRCFKRLLRGSERGRSRSPNERTEPTGQVHGCGDGSGMTGHHGWGYGQDDGPSHWHKLYPIAQGDRQSPINIISSQAVYSPSLQPLELSYEACMSLSITNNGHSVQVDFNDSDDRTVVTGGPLEGPYRLKQFHFHWGKKHDVGSEHTVDGKSFPSELHLVHWNAKKYSTFGEAASAPDGLAVVGVFLETGDEHPSMNRLTDALYMVRFKGTKAQFSCFNPKCLLPASRHYWTYPGSLTTPPLSESVTWIVLREPICISERQMGKFRSLLFTSEDDERIHMVNNFRPPQPLKGRVVKASFRA

SEQ ID NO: 797827 - protein, 149 aa, Homo sapiens
MTEPLHLVHWNAKKYSTFGEAASAPDGLAVVGVFLETGDEHPSMNRLTDALYMVRFKGTKAQFSCFNPKCLLPASRHYWTYPGSLTTPPLSESVTWIVLREPICISERQMGKFRSLLFTSEDDERIHMVNNFRPPQPLKGRVVKASFRA

SEQ ID NO: 797828 - protein, 208 aa, Homo sapiens
MSLSITNNGHSVQVDFNDSDDRTVVTGGPLEGPYRLKQFHFHWGKKHDVGSEHTVDGKSFPSELHLVHWNAKKYSTFGEAASAPDGLAVVGVFLETGDEHPSMNRLTDALYMVRFKGTKAQFSCFNPKCLLPASRHYWTYPGSLTTPPLSESVTWIVLREPICISERQMGKFRSLLFTSEDDERIHMVNNFRPPQPLKGRVVKASFRA

SEQ ID NO: 797829 - protein, 188 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAHCDTTSQWGGEDSFTCPINPLLV

SEQ ID NO: 797830 - protein, 200 aa, Homo sapiens
MVRYSLDPENPTKSCKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAQKKKISQKKLEETKTYWHGSKFSIKINVINKEKKK

SEQ ID NO: 797831 - protein, 193 aa, Homo sapiens
STFCTHSERTPPNVDSSVAKKSRGSNLRVHFKNTRETAQAIKGMHIRKATKYLKDVTLQKQCVPFRRYNGGVGRCAQAKQWGWTQGRWPKKSAEFLLHMLKNAESNAELKGLDVDSLVIEHIQVNKAPKMRRRTYRAHGRINPYMSSPCHIEMILTEKEQIVPKPEEEVAHCDTTSQWGGEDSFTCPINPLLV

SEQ ID NO: 797832 - protein, 166 aa, Homo sapiens
MLVISNERLPSPSQGLLPTLDYERHSFGVRGFSESPPLPPLLPHPLVPFRITWPPISHIPDPGTRVPFFRPSVLLPPLLRVSVPRGCSPPPPVSQASSRRWSRVPVLRWLRESGVRSAFFPFLSYICLFESAPARPVSLPSLLGPLLLFYFSLATPVLSNSLFRTH

SEQ ID NO: 797833 - protein, 166 aa, Homo sapiens; identical to SEQ ID NO: 797832

SEQ ID NO: 797834 - protein, 71 aa, Homo sapiens
SPALRPPFCCTQTGSPPLTTGQKGKGVQASKTNDLHLGADPSCSQLGPSPSVGTRKIFAHLEKLLVQPNFI

SEQ ID NO: 797835 - protein, 114 aa, Homo sapiens
MLIFQHQGAQTILLEMLVVFLYLIVLVLCGKVILSEEAPGLTPFSCCELILQELWPLLNRPFALGLNQYKVYPQIFALYQKVLLCGPLRLFVHIIFSLSHLTAASTLYNGVQEN

SEQ ID NO: 797836 - protein, 114 aa, Homo sapiens; identical to SEQ ID NO: 797835

SEQ ID NO: 797837 - protein, 125 aa, Homo sapiens
LDSRQRNERNVRWVRHYINHSLCGQEPRQAASATSSLRPGKSNLPKCPRLASVPFPTAAIMNIHCPIISPLDEDYSTYFTEEIKVLMQPGNTTGAKRGLALCMEAEGLKFAFDHLQLLAPVVAVF

SEQ ID NO: 797838 - protein, 73 aa, Homo sapiens
VDYQAALGATVFSFFSLLRAVCYSVKLFSTVLTLQFDRATSFFLDINPGPTEQRVQKGLYRFPGRIAKLQGFR

SEQ ID NO: 797839 - protein, 111 aa, Homo sapiens
MADLQKTRKQKDGTDTSQSGEDGGCWQREREDSGDAEAHAFKSPSKENKKKDKDMLEDKFKSNNLEREQEQLDRIVKESGGKLTRRLVNSQCKFERRTQTEQQCWDFSILW

SEQ ID NO: 797840 - protein, 117 aa, Homo sapiens
LLFLENTEAPASPQGSSSASLVETEDPSLEDTSVPSVPLGSRQCFLYPGPGGSYGFRLSCVASGPRLFISQVTDAPWILNPFDPLLPDRSSSASLPEPKASKLSPGVPCSACPHNTR

SEQ ID NO: 797841 - protein, 226 aa, Homo sapiens
WVADPAMEKAADLQDTASLTLKFKFNPKLGIDNPVLSLAEDHDPYDPWSLEPPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGVSVEKFTHNQLTRKV

SEQ ID NO: 797842 - protein, 324 aa, Homo sapiens
MSVEDGGMPGLGRPRQARWTLMLLLSTAMYGAHAPLLALCHVDGRVPFRPSSAVLLTELTKLLLCAFSLLVGWQAWPQGPPPWRQAAPFALSALLYGANNNLVIYLQRYMDPSTYQVLSNLKIGSTAVLYCLCLRHRLSVRQGLALLLLMAAGACYAAGGLQVPGNTLPSPPPAAAASPMPLHITPLGLLLLILYCLISGLSSVYTELLMKRQRLPLALQNLFLYTFGVLLNLGLHAGGGSGPGLLEGFSGWAALVVLSQALNGLLMSAVMKHGSSITRLFVVSCSLVVNAVLSAVLLRLQLTAAFFLATLLIGLAMRLYYGSR

SEQ ID NO: 797843 - protein, 324 aa, Homo sapiens; identical to SEQ ID NO: 797842

SEQ ID NO: 797844 - protein, 324 aa, Homo sapiens; identical to SEQ ID NO: 797842

SEQ ID NO: 797845 - protein, 324 aa, Homo sapiens; identical to SEQ ID NO: 797842

SEQ ID NO: 797846 - protein, 324 aa, Homo sapiens; identical to SEQ ID NO: 797842

SEQ ID NO: 797847 - protein, 324 aa, Homo sapiens; identical to SEQ ID NO: 797842

SEQ ID NO: 797848 - protein, 324 aa, Homo sapiens; identical to SEQ ID NO: 797842

SEQ ID NO: 797849 - protein, 324 aa, Homo sapiens; identical to SEQ ID NO: 797842

SEQ ID NO: 797850 - protein, 324 aa, Homo sapiens; identical to SEQ ID NO: 797842

SEQ ID NO: 797851 - protein, 324 aa, Homo sapiens; identical to SEQ ID NO: 797842

SEQ ID NO: 797852 - protein, 324 aa, Homo sapiens; identical to SEQ ID NO: 797842

SEQ ID NO: 797853 - protein, 324 aa, Homo sapiens; identical to SEQ ID NO: 797842

SEQ ID NO: 797854 - protein, 324 aa, Homo sapiens; identical to SEQ ID NO: 797842

SEQ ID NO: 797855 - protein, 224 aa, Homo sapiens
MSVEDGGMPGLGRPRQARWTLMLLLSTAMYGAHAPLLALCHVDGRVPFRPSSAVLLTELTKLLLCAFSLLVGWQAWPQGPPPWRQAAPFALSALLYGANNNLVIYLQRYMDPSTYQVLSNLKIGSTAVLYCLCLRHRLSVRQGLALLLLMAAGACYAAGGLQVPGNTLPSPPPAAAASPMPLHITPLGLLLLILYCLISGLSSVYTELLMNSAQSDLRPGTGNL

SEQ ID NO: 797856 - protein, 221 aa, Homo sapiens
MARRRYMDPSTYQVLSNLKIGSTAVLYCLCLRHRLSVRQGLALLLLMAAGACYAAGGLQVPGNTLPSPPPAAAASPMPLHITPLGLLLLILYCLISGLSSVYTELLMKRQRLPLALQNLFLYTFGVLLNLGLHAGGGSGPGLLEGFSGWAALVVLSQALNGLLMSAVMKHGSSITRLFVVSCSLVVNAVLSAVLLRLQLTAAFFLATLLIGLAMRLYYGSR

SEQ ID NO: 797857 - protein, 103 aa, Homo sapiens
MADDKDSLPKLKDLAFLKNQLESLQRRVEDEVNSGVGQDGSLLSSPFLKGFLAGYVVAKLRASAVLGFAVGTCTGIYAAQAYAVPNVEKTLRDYLQLLRKGPD

SEQ ID NO: 797858 - protein, 103 aa, Homo sapiens; identical to SEQ ID NO: 797857

SEQ ID NO: 797859 - protein, 103 aa, Homo sapiens; identical to SEQ ID NO: 797857

SEQ ID NO: 797860 - protein, 103 aa, Homo sapiens; identical to SEQ ID NO: 797857

SEQ ID NO: 797861 - protein, 103 aa, Homo sapiens; identical to SEQ ID NO: 797857

SEQ ID NO: 797862 - protein, 384 aa, Homo sapiens
PVLGGAGAGGSSGRSGSADVLPSSPGSEAAMAESPTEEAATAGAGAAGPGASSVAGVVGVSGSGGGFGPPFLPDVWAAAAAAGGAGGPGSGLAPLPGLPPSAAAHGAALLSHWDPTLSSDWDGERTAPQCLLRIKRDIMSIYKEPPPGMFVVPDTVDMTKIHALITGPFDTPYEGGFFLFVFRCPPDYPIHPPRVKLMTTGNNTVRFNPNFYRNGKVCLSILGTWTGPAWSPAQSISSVLISIQSLMTENPYHNEPGFEQERHPGDSKNYNECIRHETIRVAVCDMMEGKCPCPEPLRGVMEKSFLEYYDFYEVACKDRLHLQGQTMQDPFGEKRGHFDYQSLLMRLGLIRQKVLERLHNENAEMDSDSSSSGTETDLHGSLRV

SEQ ID NO: 797863 - protein, 246 aa, Homo sapiens
MSIYKEPPPGMFVVPDTVDMTKIHALITGPFDTPYEGGFFLFVFRCPPDYPIHPPRVKLMTTGNNTVRFNPNFYRNGKVCLSILGTWTGPAWSPAQSISSVLISIQSLMTENPYHNEPGFEQERHPGDSKNYNECIRHETIRVAVCDMMEGKCPCPEPLRGVMEKSFLEYYDFYEVACKDRLHLQGQTMQDPFGEKRGHFDYQSLLMRLGLIRQKVLERLHNENAEMDSDSSSSGTETDLHGSLRV

SEQ ID NO: 797864 - protein, 246 aa, Homo sapiens; identical to SEQ ID NO: 797863

SEQ ID NO: 797865 - protein, 297 aa, Homo sapiens
PVLGGAGAGGSSGRSGSADVLPSSPGSEAAMAESPTEEAATAGAGAAGPGASSVAGVVGVSGSGGGFGPPFLPDVWAAAAAAGGAGGPGSGLAPLPGLPPSAAAHGAALLSHWDPTLSSDWDGERTAPQCLLRIKRTWTGPAWSPAQSISSVLISIQSLMTENPYHNEPGFEQERHPGDSKNYNECIRHETIRVAVCDMMEGKCPCPEPLRGVMEKSFLEYYDFYEVACKDRLHLQGQTMQDPFGEKRGHFDYQSLLMRLGLIRQKVLERLHNENAEMDSDSSSSGTETDLHGSLRV

SEQ ID NO: 797866 - protein, 384 aa, Homo sapiens; identical to SEQ ID NO: 797862

SEQ ID NO: 797867 - protein, 384 aa, Homo sapiens; identical to SEQ ID NO: 797862

SEQ ID NO: 797868 - protein, 384 aa, Homo sapiens; identical to SEQ ID NO: 797862

SEQ ID NO: 797869 - protein, 384 aa, Homo sapiens; identical to SEQ ID NO: 797862

SEQ ID NO: 797870 - protein, 222 aa, Homo sapiens
GSRWCGSGREQRPLWSADVLPSSPGSEAAMAESPTEEAATAGAGAAGPGASSVAGVVGVSGSGGGFGPPFLPDVWAAAAAAGGAGGPGSGLAPLPGLPPSAAAHGAALLSHWDPTLSSDWDGERTAPQCLLRIKRDIMSIYKEPPPGMFVVPDTVDMTKIHALITGPFDTPYEGGFFLFVFRCPPDYPIHPPRVKLMTTGNNTVRFNPNFYRNGKVCLSILG

SEQ ID NO: 797871 - protein, 384 aa, Homo sapiens; identical to SEQ ID NO: 797862

SEQ ID NO: 797872 - protein, 278 aa, Homo sapiens
GSRWCGSGREQRPLWSADVLPSSPGSEAAMAESPTEEAATAGAGAAGPGASSVAGVVGVSGSGGGFGPPFLPDVWAAAAAAGGAGGPGSGLAPLPGLPPSAAAHGAALLSHWDPTLSSDWDGERTAPQCLLRIKRDIMSIYKEPPPGMFVVPDTVDMTKIHALITGPFDTPYEGGFFLFVFRCPPDYPIHPPRVKLMTTGNNTVRFNPNFYRNGKVCLSILGTWTGPAWSPAQSISSVLISIQSLMTENPYHNEPGFEQERHPETAKTIIAVTRWSGS

SEQ ID NO: 797873 - protein, 72 aa, Homo sapiens
ILRWGFILQIHALITGPFDTPYEGGFFLFVFRCPPDYPIHPPRVKLMTTGNNTVRFNPNFYRNGKVCLSILG

SEQ ID NO: 797874 - protein, 96 aa, Homo sapiens
MEHKEVVLLLLLFLKSGQGEPLDDYVNTQGPSLFSVTKKQLGAGSREECAAKCEEDKEFTCRAFQYHSKEQQCVIMAENRKSSIIIRMRDAVLFEK

SEQ ID NO: 797875 - protein, 96 aa, Homo sapiens; identical to SEQ ID NO: 797874

SEQ ID NO: 797876 - protein, 96 aa, Homo sapiens; identical to SEQ ID NO: 797874

SEQ ID NO: 797877 - protein, 629 aa, Homo sapiens [sequence omitted]

SEQ ID NO: 797878 - protein, 632 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKTFKLKKREKRRSTSRQFVDGPPGPVKKTRSIGSAVDQGNESIVAKTTVTVPNDGGPIEAVSTIETVPYWTRSRRKTGTLQPWNSDSTLNSRQLEPRTETDSVGTPQSNGGMRLHDFVSKTVIKPESCVPCGKRIKFGKLSLKCRDCRVVSHPECRDRCPLPCIPTLIGTPVKIGEGMLADFVSQTSPMIPSIVVHCVNEIEQRGLTETGLYRISGCDRTVKELKEKFLRVKTVPLLSKVDDIHAICSLLKDFLRNLKEPLLTFRLNRAFMEAAEITDEDNSIAAMYQAVGELPQANRDTLAFLMIHLQRVAQSPHTKMDVANLAKVFGPTIVAHAVPNPDPVTMLQDIKRQPKVVERLLSLPLEYWSQFMMVEQENIDPLHVIENSNAFSTPQTPDIKVSLLGPVTTPEHQLLKTPSSSSLSQRVRSTLTKNTPRFGSKSKSATNLGRQGNFFASPMLK

SEQ ID NO: 797879 - protein, 255 aa, Homo sapiens
MELLVARTQMISVSRAFAGKLKFLRVKTVPLLSKVDDIHAICSLLKDFLRNLKEPLLTFRLNRAFMEAAEITDEDNSIAAMYQAVGELPQANRDTLAFLMIHLQRVAQSPHTKMDVANLAKVFGPTIVAHAVPNPDPVTMLQDIKRQPKVVERLLSLPLEYWSQFMMVEQENIDPLHVIENSNAFSTPQTPDIKVSLLGPVTTPEHQLLKTPSSSSLSQRVRSTLTKNTPRFGSKSKSATNLGRQGNFFASPMLK

SEQ ID NO: 797880 - protein, 149 aa, Homo sapiens
MDVAKDFSQIGTSILVFGPTIVAHAVPNPDPVTMLQDIKRQPKVVERLLSLPLEYWSQFMMVEQENIDPLHVIENSNAFSTPQTPDIKVSLLGPVTTPEHQLLKTPSSSSLSQRVRSTLTKNTPRFGSKSKSATNLGRQGNFFASPMLK

SEQ ID NO: 797881 - protein, 607 aa, Homo sapiens
MDTMMLNVRNLFEQLVRRVEILSEGNEVQFIQLAKDFEDFRKKWQRTDHELGKYKDLLMKAETERSALDVKLKHARNQVDVEIKRRQRAEADCEKLERQIQLIREMLMCDTSGSIQLSEEQKSALAFLNRGQPSSSNAGNKRLSTIDESGSILSDISFDKTDESLDWDSSLVKTFKLKKREKRRSTSRQFVDGPPGPVKKTRSIGSAVDQGNESIVAKTTVTVPNDGGPIEAVSTIETVPYWTRSRRKTGTLQPWNSDSTLNSRQLEPRTETDSVGTPQSNGGMRLHDFVSKTVIKPESCVPCGKRIKFGKLSLKCRDCRVVSHPECRDRCPLPCIPTLIGTPVKIGEGMLADFVSQTSPMIPSIVVHCVNEIEQRGLTETGLYRISGCDRTVKELKEKFLRVKTVPLLSKVDDIHAICSLLKDFLRNLKEPLLTFRLNRAFMEAAEITDEDNSIAAMYQAVGELPQANRDTLAFLMIHLQRVAQSPHTKMDVANLAKVFGPTIVAHAVPNPDPVTMLQDIKRQPKVVERLLSLPLEYWSQFMMVEQENIDPLHVIENSNAFSTPQTPDIKAVPGGGLCVHFTAGEAEIQKGPPSCGQNKSTAAFNY

SEQ ID NO: 797882 - protein, 632 aa, Homo sapiens; identical to SEQ ID NO: 797878

SEQ ID NO: 797883 - protein, 632 aa, Homo sapiens; identical to SEQ ID NO: 797878

SEQ ID NO: 797884 - protein, 68 aa, Homo sapiens
TRPRTRGLSLLGPVTTPEHQLLKTPSSSSLSQRVRSTLTKNTPRFGSKSKSATNLGRQGNFFASPMLK

SEQ ID NO: 797885 - protein, 503 aa, Homo sapiens
LPAGTKCLESLLGSVPPPCPGLHSLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLGPQMFMDCSPQALPIASEDTTGQHDHHFLDPNCHICKDWEPSNELLGSFEAAKSCGDNIFQKALSQTPMPPWEGVLDMFSIKRFRARAQLVSGHSCRLVQALPTVIRSAGCIPSNIVWDLLASICPAKAKVWRSLTQVCCWLCCSPRKGFQTQQGPAPGWGKVQKMVSFNSKVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 797886 - protein, 190 aa, Homo sapiens
ISQMTGGRMYLFSTLLVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 797887 - protein, 189 aa, Homo sapiens
LPAGTKCLESLLGSVPPPCPGLHSLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLVVKLEPDLVLGRAHAWGSHASPHQQCGLGHVT

SEQ ID NO: 797888 - protein, 243 aa, Homo sapiens
WSTWGWSCCPCLPSSPCPPGCALWGAQVWRSLTQVCCWLCCSPRKGFQTQQGPAPGWGKVQKMVSFNSKVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 797889 - protein, 606 aa, Homo sapiens
LPAGTKCLESLLGSVPPPCPGLHSLRELPDPVLSEEVVEGIAAGIEAALWDLTQGTNGRYKTKYRSLLFNLRDPRNLDLFLKVVHGDVTPYDLVRMSSMQLAPQELARWRDQEEKRGPQMFMDCSPQALPIASEDTTGQHDHHFLDPNCHICKDWEPSNELLGSFEAAKSCGDNIFQKALSQTPMPAPEMPKTRELSPTEPQDRCGVGSREVDNPAGLRGRPPPGATDIALAFPVWPWASLPSLGNLTFPICAMELIIPASWQPPAQGQAWASVPVPTVGTQDLLRKERRCRGSPHGLLCLALSSVPPSRVPPSGLHVPAAPTKALPCLPPWEGVLDMFSIKRFRARAQLVSGHSCRLVQALPTVIRSAGCIPSNIVWDLLASICPAKAKVWRSLTQVCCWLCCSPRKGFQTQQGPAPGWGKVQKMVSFNSKVEKRYYQPDDRRPNVPLKGTPPPGGAWQQSQGRGSIAPRGISAWQRPPRGRGRLWPEPENWQHPGRGQWPPEPGLRQSQHPYSVAPAGHGFGRGQHFHRDSCPHQALLRHLESLATMSHQLQALLCPQTKSSIPRPLQRLSSALAAPEPPGPARDSSLGPTDEAGSECPFPRKA

SEQ ID NO: 797890 - protein, 300 aa, Homo sapiens
LPAGTKCLESLLGSVPPPCPGLHSLRELPDPVLSEEVVEGIAAGIEAALWDLTQGTNGRYKTKYRSLLFNLRDPRNLDLFLKVVHGDVTPYDLVRMSSMQLAPQELARWRDQEEKRGLNIIEQQQKEPCRLPASKMTHKGEVEIQRDMDQTLTLEDLGPQMFMDCSPQALPIASEDTTGQHDHHFLDPNCHICKDWEPSNELLGSFEAAKSCGDNIFQKALSQTPMPAPEMPKTRELSPTEPQDRVPPSGLHVPAAPTKALPCLPPWEGVLDMFSIKRFRARAQLVSGHSCRLVQPWPSP

SEQ ID NO: 797891 - protein, 127 aa, Homo sapiens
WCQTHILSYPQYLPLLPIILFWISNMLSLLFLCTLHPSLSLPSLRLTLTPIRLSKLPGLYCRKASQTAPITSVKPKFHPHLLVILLFTVLNYSYMPCSCLHCRFTLFLQAITADIAWCYPQTATLNS

SEQ ID NO: 797892 - protein, 111 aa, Homo sapiens
TASSSAETLRTVRRRSVPSSSMPYLALAHNRVSSLNHAASVDGWGTSHRNVADSFSRTSRSCSRFLKGTAGSARREDCYFEAYMGSWFLDPRIYQNLCILKFYGQPCGTQA

SEQ ID NO: 797893 - protein, 239 aa, Homo sapiens
MHKPIRLRPASLTSTVLGTGAWWRSCRWGPEKPPQRAKAQGQPEDRTPEEDRKNQEDQRNREEAPEQGKERPRHQDMDAVEPGGRGWASMLACRLWKAISRALFAEFLATGLYVFFGVGSVMRWPTALPSVLQIAITFNLVTAMAVQVTWKASGAHANPAVTLAFLVGSHISLPRAVAYVAAQLVGATVGAALLYGVMPGDIRETLGINVAPPTSSALRLFPSSSLHLEACLTRPFSIS

SEQ ID NO: 797894 - protein, 358 aa, Homo sapiens
MHKPIRLRPASLTSTVLGTGAWWRSCRWGPEKPPQRAKAQGQPEDRTPEEDRKNQEDQRNREEAPEQGKERPRHQDMDAVEPGGRGWASMLACRLWKAISRALFAEFLATGLYVFFGVGSVMRWPTALPSVLQIAITFNLVTAMAVQVTWKASGAHANPAVTLAFLVGSHISLPRAVAYVAAQLVGATVGAALLYGVMPGDIRETLGINVVRNSVSTGQAVAVELLLTLQLVLCVFASTDSRQTSGSPATMIGISVALGHLIGIHFTGCSMNPARSFGPAIIIGKFTVHWVFWVGPLMGALLASLIYNFVLFPDTKTLAQRLAILTGTVEVGTGAGAGAEPLKKESQPGSGAVEMESV

SEQ ID NO: 797895 - protein, 239 aa, Homo sapiens; identical to SEQ ID NO: 797893

SEQ ID NO: 797896 - protein, 542 aa, Homo sapiens
MAEVEAGGELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSGGYPGSAPLQRNFSINSVATLFSAS

SEQ ID NO: 797897 - protein, 580 aa, Homo sapiens
MAEVEAGGELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSGGYPGSAPLQRNFSINSVASTYSEFAKDPSLSDSSTVGLQRELSKASKSDATSGILNSTNIQS

SEQ ID NO: 797898 - protein, 543 aa, Homo sapiens
MAEVEAGGELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSENFQRLPNLMLLLESSIQPTSSPEKP

SEQ ID NO: 797899 - protein, 356 aa, Homo sapiens
MQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSGGYPGSAPLQRNFSINSVATLFSAS

SEQ ID NO: 797900 - protein, 557 aa, Homo sapiens
MAEVEAGGELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILRRIRPSLTVPLLGFSENFQRLPNLMLLLESSIQPTSSPEKP

SEQ ID NO: 797901 - protein, 580 aa, Homo sapiens; identical to SEQ ID NO: 797897

SEQ ID NO: 797902 - protein, 581 aa, Homo sapiens
MAEVEAGGELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSGGYPGSAPLQRNFSINSVASTYSEFAKDPSLSDSSTVGLQDSLPPEENVFVCPKLRWPALLPKR

SEQ ID NO: 797903 - protein, 533 aa, Homo sapiens
NYRLQVEAGGELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILRTAFLLKRMSLCVRS

SEQ ID NO: 797904 - protein, 542 aa, Homo sapiens; identical to SEQ ID NO: 797896

SEQ ID NO: 797905 - protein, 542 aa, Homo sapiens; identical to SEQ ID NO: 797896

SEQ ID NO: 797906 - protein, 542 aa, Homo sapiens; identical to SEQ ID NO: 797896

SEQ ID NO: 797907 - protein, 538 aa, Homo sapiens
MAEVEAGGELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSENFQRLPNLMLLLESLNHYSS

SEQ ID NO: 797908 - protein, 328 aa, Homo sapiens
TIGLVEAGGELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLE

SEQ ID NO: 797909 - protein, 97 aa, Homo sapiens
GTFKGIYGEWAEIHGVCGRTMGDASIGERESQAGKSKCERERKLGKDEESNLSSPYSLPGTRVCGTGSRGPGLVEREAGDRGLWNGEPGTGACGTGS

SEQ ID NO: 797910 - protein, 164 aa, Homo sapiens
MYFSQRKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKVNTRLRETLISREWVRVVPATSLKGASPSTPVGISHQVGQE

SEQ ID NO: 797911 - protein, 566 aa, Homo sapiens
MAEVEAGGELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSGGYPGSAPLQRNFSINSVASTYSEFARELSKASKSDATSGILNSTNIQS

SEQ ID NO: 797912 - protein, 518 aa, Homo sapiens
MAEVEAGGELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGGGYPGSAPLQRNFSINSVATLFSAS

SEQ ID NO: 797913 - protein, 542 aa, Homo sapiens; identical to SEQ ID NO: 797896

SEQ ID NO: 797914 - protein, 542 aa, Homo sapiens; identical to SEQ ID NO: 797896

SEQ ID NO: 797915 - protein, 481 aa, Homo sapiens
MAEVEAGGELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPHSCAYFA

SEQ ID NO: 797916 - protein, 315 aa, Homo sapiens
MMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEELDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLE

SEQ ID NO: 797917 - protein, 192 aa, Homo sapiens
MAAPPKAPIRVRNLTIRAGALTGKENNMLQPETHIFTAPEEGSSQGALLLGQAPEPLSLPCTPVTLEQQLVSPSGDPHRAPALPSICSTLILQPCATLDPLLLQPQVPKVSDQALVSAHSEWQRKLEAAEALLTLRNSAQAPPDSISLHQPCNPPAPAGDKGFQPPSPSLRPRPASSISLPIGHLGCISLLS

SEQ ID NO: 797918 - protein, 192 aa, Homo sapiens; identical to SEQ ID NO: 797917

SEQ ID NO: 797919 - protein, 127 aa, Homo sapiens
MAAPPKAPIRVRNLTIRAGALTGKENNMLQPETHIFTAPEEVPKVSDQALVSAHSEWQRKLEAAEALLTLRNSAQAPPDSISLHQPCNPPAPAGDKGFQPPSPSLRPRPASSISLPIGHLGCISLLS

SEQ ID NO: 797920 - protein, 150 aa, Homo sapiens
CSSSSSSSSSSSSFSSSSRSEGGGLRLKTLGLRVFLAAAAAAAATSLSSRPGTQRSGRRMPVDAHLFPEFLLPGPAKAAGENVRGRGDTQGLRVSEARWPAPLLLAQETPTGAPAAGTPSAPRSPGSTSSEAWSPCSGASESSFVDPRNP

SEQ ID NO: 797921 - protein, 145 aa, Homo sapiens
YREKPRGRADRFYVREKLDAHAPWSILAFPGEKRIPEKQPNLSALVEKGISEAGRKPGQVSFIRLPKGTSTHLPETWPSGSSWQHHPLPVPTTIRLPPGVLQDSQRRPFRSTELEDSCSWITPEWRSKLLPLAESLCFLCLDSED

SEQ ID NO: 797922 - protein, 514 aa, Homo sapiens
RLGRFLQGCPPEGPAREGRGHRVKIKIRQLQPLEGQRLASVPLAGSSQESPRARRSQAAAGRGRCSGMAEERPGAWFGFGFCGFGQELGSGRGRQVHSPSPLRAGVDICRVSASWSYTAFVTREHSPPRPHLFQPRSPVASPHRCGQSSLSPPFRPPAPHSGLVPNSTPSQEHPAPPTPAASILATLLQIRPAGGGRLELSGSASGAAGRCKDAWASEGLLAVLRAGPGPEALLQVWAAESALRGEPLWAQNVVPEAEGEDDPAGEAQAGRLPLLPCARAYVSPRAPFYRPLAPELRARQLELGAEHALLLDAAGQVFSWGGGRHGQLGHGTLEAELEPRLLEALQGLVMAEVAAGGWHSVCVSETGDIYIWGWNESGQLALPTRNLAEDGETVAREATELNEDGSQVKRTGGAEDGAPAPFIAVQPFPALLDLPMGSDAVKASCGSRHTAVVTRTGELYTWGWGKYGQLGHEDTTSLDRPRRVEYFVDKQLQVKAVTCGPWNTYVYAVEKGKS

SEQ ID NO: 797923 - protein, 49 aa, Homo sapiens [sequence omitted]

SEQ ID NO: 797924 - protein, 376 aa, Homo sapiens
MAEERPGAWFGFGFCGFGQELGSGRGRQVHSPSPLRAGVDICRVSASWSYTAFVTRGGRLELSGSASGAAGRCKDAWASEGLLAVLRAGPGPEALLQVWAAESALRGEPLWAQNVVPEAEGEDDPAGEAQAGRLPLLPCARAYVSPRAPFYRPLAPELRARQLELGAEHALLLDAAGQVFSWGGGRHGQLGHGTLEAELEPRLLEALQGLVMAEVAAGGWHSVCVSETGDIYIWGWNESGQLALPTRNLAEDGETVAREATELNEDGSQVKRTGGAEDGAPAPFIAVQPFPALLDLPMGSDAVKASCGSRHTAVVTRTGELYTWGWGKYGQLGHEDTTSLDRPRRVEYFVDKQLQVKAVTCGPWNTYVYAVEKGKS

SEQ ID NO: 797925 - protein, 328 aa, Homo sapiens
MAEERPGAWFGFGFCGFGQELGSGRGRQVHSPSPLRAGVDICRVSASWSYTAFVTRGGRLELSGSASGAAGRCKDAWASEGLLAVLRAGPGPEALLQVWAAESALRGEPLWAQNVVPEAEGEDDPAGEAQAGRLPLLPCARAYVSPRAPFYRPLAPELRARQLELGAEHALLLDAAGQVFSWGGGRHGQLGHGTLEAELEPRLLEALQGLVMAEVAAGGWHSVCVSETGDIYIWGWNESGQLALPTRNLAEDGETVAREATELNEDGSQVKRTGGAEDGAPAPFIAVQPFPALLDLPMGSDAVKASCGSRHTAVVTRTGELYTWGWGK

SEQ ID NO: 797926 - protein, 376 aa, Homo sapiens; identical to SEQ ID NO: 797924

SEQ ID NO: 797927 - protein, 447 aa, Homo sapiens
MAEERPGAWFGFGFCGFGQELGSGRGRQVHSPSPLRAGVDICRVSASWSYTAFVTREHSPPRPHLFQPRSPVASPHRCGQSSLSPPFRPPAPHSGLVPNSTPSQEHPAPPTPAASILATLLQIRPAGGGRLELSGSASGAAGRCKDAWASEGLLAVLRAGPGPEALLQVWAAESALRGEPLWAQNVVPEAEGEDDPAGEAQAGRLPLLPCARAYVSPRAPFYRPLAPELRARQLELGAEHALLLDAAGQVFSWGGGRHGQLGHGTLEAELEPRLLEALQGLVMAEVAAGGWHSVCVSETGDIYIWGWNESGQLALPTRNLAEDGETVAREATELNEDGSQVKRTGGAEDGAPAPFIAVQPFPALLDLPMGSDAVKASCGSRHTAVVTRTGELYTWGWGKYGQLGHEDTTSLDRPRRVEYFVDKQLQVKAVTCGPWNTYVYAVEKGKS

SEQ ID NO: 797928 - protein, 447 aa, Homo sapiens; identical to SEQ ID NO: 797927

SEQ ID NO: 797929 - protein, 376 aa, Homo sapiens; identical to SEQ ID NO: 797924

SEQ ID NO: 797930 - protein, 263 aa, Homo sapiens
MAEERPGAWFGFGFCGFGQELGSGRGRQVHSPSPLRAGVDICRVSASWSYTAFVTRGGRLELSGSASGAAGRCKDAWASEGLLAVLRAGPGPEALLQVWAAESALRGEPLWAQNVVPEAEGEDDPAGEAQAGRLPLLPCARAYVSPRAPFYRPLAPELRARQLELGAEHALLLDAAGQVFSWGGGRHGQLGHGTLEAELEPRLLEALQGLVMAEVAAGGWHSVCVSETGDIYIWGWNESGQLALPTRNLAEDGETVAREATKS

SEQ ID NO: 797931 - protein, 266 aa, Homo sapiens
TRERLPAGAVQLLIMGTIHLFRKPQRSFFGKLLREFRLVAADRRSWKILLFGVINLICTGFLLMWCSSTNSIALTAYTYLTIFDLFSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGK

SEQ ID NO: 797932 - protein, 195 aa, Homo sapiens
TRERLPAGAVQLLIMGTIHLFRKPQRSFFGKLLREFRLVAADRRSWKILLFGVINLICTGFLLMWCSSTNSIALTAYTYLTIFDLFSLMTCLISYWVTLRKPSPVYSFGFERLEVLAVFASTVLAQLGALFILKESAERFLEQPEIHTGRLLVGTFVALCFNLFTMLSIRNKPFAYVSEACVELFRDLAVSSFPE

SEQ ID NO: 797933 - protein, 306 aa, Homo sapiens
TRERLPAGAVQLLIMGTIHLFRKPQRSFFGKLLREFRLVAADRRSWKILLFGVINLICTGFLLMWCSSTNSIALTAYTYLTIFDLFRDGVSPFWLGWSQTPDLKWSTHLGLPKCWDNRRELPCLSNSLMTCLISYWVTLRKPSPVYSFGFERLEVLAVFASTVLAQLGALFILKESAERFLEQPEIHTGRLLVGTFVALCFNLFTMLSIRNKPFAYVSEAASTSWLQEHVADLSRSLCGIIPGLSSIFLPRMNPFVLIDLAGAFALCITYMLIEINNYFAVDTASAIAIALMTFGTMYPMSVYSGK

SEQ ID NO: 797934 - protein, 154 aa, Homo sapiens [sequence omitted]

SEQ ID NO: 797935 - protein, 419 aa, Homo sapiens
MSRDVCIHTWPCTYYLEPKRRWVTGQLSLTSLSLRFMTDSTGEILVSFPLSSIVEIKKEASHFIFSSITILEKGHAKHWFSSLRPSRNVVFSIIEHFWRELLLSQPGAVADASVPRTRGEELTGLMAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQILRRMKGLALEAESELERQDEALDGVAAAVDRATLTIDKHNRRMKRLT

SEQ ID NO: 797936 - protein, 435 aa, Homo sapiens
MRQKRPGPWRTQTQEQMSRDVCIHTWPCTYYLEPKRRWVTGQLSLTSLSLRFMTDSTGEILVSFPLSSIVEIKKEASHFIFSSITILEKGHAKHWFSSLRPSRNVVFSIIEHFWRELLLSQPGAVADASVPRTRGEELTGLMAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQILRRMKGLALEAESELERQDEALDGVAAAVDRATLTIDKHNRRMKRLT

SEQ ID NO: 797937 - protein, 459 aa, Homo sapiens
EGARLRDEGYPARSLADAGDIDPQASEVAVGEGARLAVHPAQHGSKDPPPHFRRSGNGEDQPRNQKTQGAAFLPPSAWGSGPARMRAARRGLHCAGAERPRRRGRLWDSSGVPQRQKRPGPWRTQTQEQMSRDVCIHTWPCTYYLEPKRRWVTGQLSLTSLSLRFMTDSTGEILVSFPLSSIVEIKKEASHFIFSSITILEKGHAKHWFSSLRPSRNVVFSIIEHFWRELLLSQPGAVADASVPRTRGEELTGLMAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAG

SEQ ID NO: 797938 - protein, 222 aa, Homo sapiens
MTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQILRRMKGLALEAESELERQDEALDGVAAAVDRATLTIDKHNRRMKRLT

SEQ ID NO: 797939 - protein, 548 aa, Homo sapiens
EGARLRDEGYPARSLADAGDIDPQASEVAVGEGARLAVHPAQHGSKDPPPHFRRSGNGEDQPRNQKTQGAAFLPPSAWGSGPARMRAARRGLHCAGAERPRRRGRLWDSSGVPQRQKRPGPWRTQTQEQMSRDVCIHTWPCTYYLEPKRRWVTGQLSLTSLSLRFMTDSTGEILVSFPLSSIVEIKKEASHFIFSSITILEKGHAKHWFSSLRPSRNVVFSIIEHFWRELLLSQPGAVADASVPRTRGEELTGLMAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQILRRMKGLALEAESELERQDEALDGVAAAVDRATLTIDKHNRRMKRLT

SEQ ID NO: 797940 - protein, 524 aa, Homo sapiens
EGARLRDEGYPARSLADAGDIDPQASEVAVGEGARLAVHPAQHGSKDPPPHFRRSGNGEDQPRNQKTQGAAFLPPSAWGSGPARMRAARRGLHCAGAERPRRRGRLWDSSGVPQRQKRPGPWRTQTQEQMSRDVCIHTWPCTYYLEPKRRWVTGQLSLTSLSLRFMTDSTGEILVSFPLSSIVEIKKEASHFIFSSITILEKGHAKHWFSSLRPSRNVVFSIIEHFWRELLLSQPGAVADASVPRTRGEELTGLMAGSQKRLEDTARVLHHQGQQLDSVMRGLDKMESDLEVADRLLTELESPAWWPFSSKLWKTPPETKPREDVSMTSCEPFGKEGILIKIPAVISHRTESHVKPGRLTVLVSGLEIHDSSSLLMHRFEREDVDDIKVHSPYEISIRQRFIGKPDMAYRLISAKMPEVIPILEVQFSKKMELLEDALVLRSARTSSPAEKSCSVWHAASGLMGRTLHREPPAGDQEGTALHLQTSLPALSEADTQELTQELENALHLPQGPPFLVWLPSLPYP

SEQ ID NO: 797941 - protein, 222 aa, Homo sapiens; identical to SEQ ID NO: 797938

SEQ ID NO: 797942 - protein, 331 aa, Homo sapiens
EGARLRDEGYPARSLADAGDIDPQASEVAVGEGARLAVHPAQHGSKDPPPHFRRSGNGEDQPRNQKTQGAAFLPPSAWGSGPARMRAARRGLHCAGAERPRRRGRLWDSSGVPQRQKRPGPWRTQTQEQMSRDVCIHTWPCTYYLEPKRRWVTGQLSLTSLSLRFMTDSTGEILVSFPLSSIVEIKKEASHFIFSSITILEKGHAKHWFSSLRPSRNVVFSIIEHFWRELLLSQPGAVADASVPRTRGEELTGLMAGSQKRLEDTARVLHHQGQQLDSVMRGLDKMESDLEVADRLLTELESPAWWPFSSKLWKTPSWRRAMPSTGSAPCG

SEQ ID NO: 797943 - protein, 119 aa, Homo sapiens
MRLPKNTPEEKDRRTAALQEGLRRAVSVPLTLAETVASLWPALQELARCGNLACRSDLQVAAKALEMGVFGAYFNVLINLRDITDEAFKDQIHHRVSSLLQEAKTQAALVLDCLETRQE

SEQ ID NO: 797944 - protein, 555 aa, Homo sapiens
SICPERSIWIKVLAMSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLEAMRLPKNTPEEKDRRTAALQEGLRRAVSVPLTLAETVASLWPALQELARCGNLACRSDLQVAAKALEMGVFGAYFNVLINLRDITDEAFKDQIHHRVSSLLQEAKTQAALVLDCLETRQE

SEQ ID NO: 797945 - protein, 555 aa, Homo sapiens; identical to SEQ ID NO: 797944

SEQ ID NO: 797946 - protein, 563 aa, Homo sapiens
SICPERSIWIKVLAMSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPGLTAGLSCIYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLEAMRLPKNTPEEKDRRTAALQEGLRRAVSVPLTLAETVASLWPALQELARCGNLACRSDLQVAAKALEMGVFGAYFNVLINLRDITDEAFKDQIHHRVSSLLQEAKTQAALVLDCLETRQE

SEQ ID NO: 797947 - protein, 509 aa, Homo sapiens
SICPERSIWIKVLAMSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLAHGGPTGGSEAGSLCAADAGGDGGLAVAGAAGTGPVWEPGLPVRPPGGGQSPGDGRVWRIFQRAHQPEGHHRRGI

SEQ ID NO: 797948 - protein, 104 aa, Homo sapiens
MTSHRPLLQLCSALLGCSVSTACLCVPLCSGSPLAPFRRTAALQEGLRRAVSVPLTLAETVASLWPALQELARCGNLACRSDLQVGGPGGPQASCRKAGSSCWG

SEQ ID NO: 797949 - protein, 331 aa, Homo sapiens
NSFLWASGSPRATQGDGCFQKPVRGACWGGAHRAPGGAEVGGASHAPALLPAKAPVCSGQGAAAARVGPAGSEAFLVVETRRGRFHSKPLFQVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLEAMRLPKNTPEEKDRRTAALQEGLRRAVSVPLTLAETVASLWPALQELARCGNLACRSDLQVAAKALEMGVFGAYFNVLINLRDITDEAFKDQIHHRVSSLLQEAKTQAALVLDCLETRQE

SEQ ID NO: 797950 - protein, 606 aa, Homo sapiens
SICPERSIWIKVLAMSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLEAMRLPKNTPEEKDRRTAALQEGLRRAVSVPLTLAETVASLWPALQELARCGNLACRSDLQVAAKALEMGVFGAYFNVLINLRDITDEAFKDQPPAGSQDPGCTGAGLLGDPAGVTVREASPGSVAPPSPIPRGQSCDLGGDTACSCGARRIGGQAAGHRLGMEALAGTEGP

SEQ ID NO: 797951 - protein, 555 aa, Homo sapiens; identical to SEQ ID NO: 797944

SEQ ID NO: 797952 - protein, 444 aa, Homo sapiens
SICPERSIWIKVLAMSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAGHGCGAGLHGGPHDLRAAPIPVPGHDDAAPDPALPRGFGQANHAGGCRRRGLHRLPGSNEAPQEHT

SEQ ID NO: 797953 - protein, 104 aa, Homo sapiens
MGVFGAYFNVLINLRDITDEAFKDQPPAGSQDPGCTGAGLLGDPAGVTVREASPGSVAPPSPIPRGQSCDLGGDTACSCGARRIGGQAAGHRLGMEALAGTEGP

SEQ ID NO: 797954 - protein, 586 aa, Homo sapiens
SICPERSIWIKVLAMSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLEAMRLPKNTPEEKDRRTAALQEGLRRAVSVPLTLAETVASLWPALQELARCGNLACRSDLQVAAKALEMGVFGAYFNVLINLRDITDEAFKDQPPAGSQDPGCTGAGLLGDPAGVTVREASPGSVAPPSPIPRGQSCDLETPGTAGPSTLEG

SEQ ID NO: 797955 - protein, 598 aa, Homo sapiens
SICPERSIWIKVLAMSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLPAIRAGEYEALPKKLQQADWAPDFGPSSFVPSWGATATGARKFLIAFNINLLGTKEQAHRIALNLREQGRGKDQPGRLKKVQGIGWYLDEKNLAQVSTNLLDFEVTALHTVYEETCREAQELSLPVVGSQLVGLVPLKALLDAAAFYCEKENLFILEEEQRIRLVVSRLGLDSLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLKLGSQRTGPCLGHAPCYSPLWELRGHGCSPYGPSPSGSVSLWQEAMRLPKNTPEEKDRRTAALQEGLRRAVSVPLTLAETVASLWPALQELARCGNLACRSDLQVAAKALEMGVFGAYFNVLINLRDITDEAFKDQIHHRVSSLLQEAKTQAALVLDCLETRQE

SEQ ID NO: 797956 - protein, 176 aa, Homo sapiens
MGAALGSMVGLMTYGRRQFQSLDTTMRRLIPPFREASAKLTTLVDADAEAFTAYLEAMRLPKNTPEEKDRRTAALQEGLRRAVSVPLTLAETVASLWPALQELARCGNLACRSDLQVAAKALEMGVFGAYFNVLINLRDITDEAFKDQIHHRVSSLLQEAKTQAALVLDCLETRQE

SEQ ID NO: 797957 - protein, 381 aa, Homo sapiens
SICPERSIWIKVLAMSQLVECVPNFSEGKNQEVIDAISGAITQTPGCVLLDVDAGPSTNRTVYTFVGPPECVVEGALNAARVASRLIDMSRHQGEHPRMGALDVCPFIPVRGVSVDECVLCAQAFGQRLAEELDVPVYLYGEAARMDSRRTLCPFSPKERIIEYLVPERGPERGLGSKSLRAFVGEVGARSAAPGGGSVAAAAAAMGAALGSMVGLMTYGRRQFQSLDTTMRRLIPPFREASAKLTTLVDADAEAFTAYLEAMRLPKNTPEEKDRRTAALQEGLRRAVSVPLTLAETVASLWPALQELARCGNLACRSDLQVAAKALEMGVFGAYFNVLINLRDITDEAFKDQIHHRVSSLLQEAKTQAALVLDCLETRQE

SEQ ID NO: 797958 - protein, 136 aa, Homo sapiens
VWKLFSEPSALWKPHRQGQRRTVAQAFRKAQFPDVSLPEVRRSTSTFWLLENDSTPPTCSLPLCKIRAALAGLLGRVSDRGVSSPTWHVISALYPLGAVILEAGLRVVAMSCLSREKHFALDTDCPFSAVRRPQPP

SEQ ID NO: 797959 - protein, 110 aa, Homo sapiens
LHGHIRKKGTGERDIFTKPQPMVTPCKALNLRIPRPGRGCLSKAAQLVLCLERAEGSSTVTASGTSDQFPQPLMKADGSMGWRRWDALERTRVRVGKKIELSSGKSKSRE

SEQ ID NO: 797960 - protein, 110 aa, Homo sapiens; identical to SEQ ID NO: 797959

SEQ ID NO: 797961 - protein, 110 aa, Homo sapiens; identical to SEQ ID NO: 797959

SEQ ID NO: 797962 - protein, 110 aa, Homo sapiens; identical to SEQ ID NO: 797959

SEQ ID NO: 797963 - protein, 110 aa, Homo sapiens; identical to SEQ ID NO: 797959

SEQ ID NO: 797964 - protein, 110 aa, Homo sapiens; identical to SEQ ID NO: 797959

SEQ ID NO: 797965 - protein, 113 aa, Homo sapiens
LPDLAHFKTLVITLGPRSSGHSLHLKTSSGILPSTSIPLHHGVVVFTKESQVPSLCFFGVFGLPLLFFQDACKYPGNWVCFSCDLPNVSFQLTASVYTLPTMFVVFVAEDFSL

SEQ ID NO: 797966 - protein, 132 aa, Homo sapiens
RPQDVPTITELEAKPSRTKSAQWPSYRFTMAFGPAHTQSILSNAKKCLYVSPSSIHAQPARTLRVPQFTIREPTSAAGRVVLWDRLGLAGQADRGAEQESMQEENPAGVSVSQELQEYRTIPSTKEASGSRS

SEQ ID NO: 797967 - protein, 71 aa, Homo sapiens
CGRAPPPAPRTLPLPLVCPAGGPACWLYASLPAVSAREKRSWVGMFVLVCGGGCRLSCQENSALTIPLLML

SEQ ID NO: 797968 - protein, 216 aa, Homo sapiens
MARSTIIHPHLRDVDRAATVSGRFLAPQQQDPKSSGGCAALLGADLPWSAPPLERATRRVHTALLDPGTGSGSGSASAKGPARRPGAEEARRSVASAVRLTEVGAQRDREERPGRGCQAPSNRGGVGVKAAPGGGRTPNPGHRPPPGLLLYPKGGRGGWEAVHDEHNLHGEENRNVPVSPAAPYRQRSPASRVPSYPTGERGPHSQLQPSPGPATA

SEQ ID NO: 797969 - protein, 113 aa, Homo sapiens
MLGGQGQPLSLGPQASLLPTVAKIAGLYNDLEPPRKTMRRGVLMTLLQQSAMTLPLWIGKPGDKPPPLCGAIPASGDYVARPGDKVAARVKAVDGDEQWILAEVVSYSHATNK

SEQ ID NO: 797970 - protein, 310 aa, Homo sapiens
MCRSAWGGPPLERTSPGARDAQGAHSPLGPRDRLRLRLGVSKGTCAAPWGGGGPTVSGQCRAADGGRGATGPGGAPRAGVPGPLQPRRGWSQGGSGRGSDPKSRPQAAARSSSLPEGRPRRMGSRARRAQSPWGGEQECSCEPRRALPPAQPSIAGPLLSHRRTGSSLPASAEPWPRNCLKARPLHLPTSGPASSPVAKIAGLYNDLEPPRKTMRRGVLMTLLQQSAMTLPLWIGKPGDKPPPLCGAIPASGDYVARPGDKVAARVKAVDGDEQWILAEVVSYSHATNKHLLCRRLLPSSQCGPEVPGSF

SEQ ID NO: 797971 - protein, 260 aa, Homo sapiens
MCRSAWGGPPLERTSPGARDAQGAHSPLGPRDRLRLRLGVSKGTCAAPWGGGGPTVSGQCRAADGGRGATGPGGAPRAGVPGPLQPRRGWSQGGSGRGSDPKSRPQAAARSSSLPEGRPRRMGSRARRAQSPWGGEQECSCEPRRALPPAQPSIAGPLLSHRRTGSSLPASAEPWPRNCLKARPLHLPTSGPASSPVAKIAGLYNDLEPPRKTMRRGVLMTLLQQSAMTLPLWIGKPGDKRLRGQTWRQGGCPGEGRGWG

SEQ ID NO: 797972 - protein, 289 aa, Homo sapiens
MCRSAWGGPPLERTSPGARDAQGAHSPLGPRDRLRLRLGVSKGTCAAPWGGGGPTVSGQCRAADGGRGATGPGGAPRAGVPGPLQPRRGWSQGGSGRGSDPKSRPQAAARSSSLPEGRPRRMGSRARRAQSPWGGEQECSCEPRRALPPAQPSIAGPLLSHRRTGSSLPASAEPWPRNCLKARPLHLPTSGPASSPVAKIAGLYNDLEPPRKTMRRGVLMTLLQQSAMTLPLWIGKPGDKPPPLCGAIPASGDYVARPGDKVAARVKAVDGDEQWILAEVVSYSHATNK

SEQ ID NO: 797973 - protein, 69 aa, Homo sapiens
ETKRLIIVFYSKTCLSATTAAITFDHSLSENTALGCGNAVVEKPGIILIPMEALSPSKGRGPASPEVSS

SEQ ID NO: 797974 - protein, 1237 aa, Homo sapiens
MGDMKTPDFDDLLAAFDIPDIDANEAIHSGPEENEGPGGPGKPEPGVGSESEDTAAASAGDGPGVPAQASDHGLPPPDISVVSVIVKNTVCPEQSEALAGGSAGDGAQAAGVTKEGPVGPHRMQNGFGSPEPSLPGTPHSPAPPSGGTWKEKGMEGKTPLDLFAHFGPEPGDHSDPLPPSAPSPTREGALTPPPFPSSFELAQENGPGMQPPVSSPPLGALKQESCSPHHPQVLAQQGSGSSPKATDIPASASPPPVAGVPFFKQSPGHQSPLASPKVPVCQPLKEEDDDEGPVDKSSPGSPQSPSSGAEAADEDSNDSPASSSSRPLKVRIKTIKTSCGNITRTVTQVPSDPDPPAPLAEGAFLAEASLLKLSPATPTSEGPKVVSVQLGDGTRLKGTVLPVATIQNASTAMLMAASVARKAVVLPGGTATSPKMIAKNVLGLVPQALPKADGRAGLGTGGQKVNGASVVMVQPSKTATGPSTGGGTVISRTQSSLVEAFNKILNSKNLLPAYRPNLSPPAEAGLALPPTGYRCLECGDAFSLEKSLARHYDRRSMRIEVTCNHCARRLVFFNKCSLLLHAREHKDKGLVMQCSHLVMRPVALDQMVGQPDITPLLPVAVPPVSGPLALPALGKGEGAITSSAITTVAAEAPVLPLSTEPPAAPATSAYTCFRCLECKEQCRDKAGMAAHFQQLGPPAPGATSNVCPTCPMMLPNRCSFSAHQRMHKNRPPHVCPECGGNFLQANFQTHLREACLHVSRRVGYRCPSCSVVFGGVNSIKSHIQTSHCEVFHKCPICPMAFKSGPSAHAHLYSQHPSFQTQQAKLIYKCAMCDTVFTHKPLLSSHFDQHLLPQRVSVFKCPSCPLLFAQKRTMLEHLKNTHQSGRLEETAGKGAGGALLTPKTEPEELAVSQGGAAPATEESSSSSEEEEVPSSPEPPRPAKRPRRELGSKGLKGGGGGPGGWTCGLCHSWFPERDEYVAHMKKEHGKSVKKFPCRLCERSFCSAPSLRRHVRVNHEGIKRVYPCRYCTEGKRTFSSRLILEKHVQVRHGLQLGAQSPGRGTTLARGSSARAQGPGRKRRQSSDSCSEEPDSTTPPAKSPRGGPGSGGHGPLRYRSSSSTEQSLMMGLRVEDGAQQCLDCGLCFASPGSLSRHRFISHKKRRGVGKASALGLGDGEEEAPPSRSDPDGGDSPLPASGGPLTCKVCGKSCDSPLNLKTHFRTHGMAFIRARQGAVGDN

SEQ ID NO: 797975 - protein, 1261 aa, Homo sapiens
MGDMKTPDFDDLLAAFDIPDIDANEAIHSGPEENEGPGGPGKPEPGVGSESEDTAAASAGDGPGVPAQASDHGLPPPDISVVSVIVKNTVCPEQSEALAGGSAGDGAQAAGVTKEGPVGPHRMQNGFGSPEPSLPGTPHSPAPPSGGTWKEKGMEGKTPLDLFAHFGPEPGDHSDPLPPSAPSPTREGALTPPPFPSSFELAQENGPGMQPPVSSPPLGALKQESCSPHHPQVLAQQGSGSSPKATDIPASASPPPVAGVPFFKQSPGHQSPLASPKVPVCQPLKEEDDDEGPVDKSSPGSPQSPSSGAEAADEDSNDSPASSSSRPLKVRIKTIKTSCGNITRTVTQVPSDPDPPAPLAEGAFLAEASLLKLSPATPTSEGPKVVSVQLGDGTRLKGTVLPVATIQNASTAMLMAASVARKAVVLPGGTATSPKMIAKNVLGLVPQALPKADGRAGLGTGGQKVNGASVVMVQPSKTATGPSTGGGTVISRTQSSLVEAFNKILNSKNLLPAYRPNLSPPAEAGLALPPTGYRCLECGDAFSLEKSLARHYDRRSMRIEVTCNHCARRLVFFNKCSLLLHAREHKDKGLVMQCSHLVMRPVALDQMVGQPDITPLLPVAVPPVSGPLALPALGKGEGAITSSAITTVAAEAPVLPLSTEPPAAPATSAYTCFRCLECKEQCRDKAGMAAHFQQLGPPAPGATSNVCPTCPMMLPNRCSFSAHQRMHKNRPPHVCPECGGNFLQANFQTHLREACLHVSRRVGYRCPSCSVVFGGVNSIKSHIQTSHCEVFHKCPICPMAFKSGPSAHAHLYSQHPSFQTQQAKLIYKCAMCDTVFTHKPLLSSHFDQHLLPQRVSVFKCPSCPLLFAQKRTMLEHLKNTHQSGRLEETAGKGAGGALLTPKTEPEELAVSQGGAAPATEESSSSSEEEEVPSSPEPPRPAKRPRRELGSKGLKGGGGGPGGWTCGLCHSWFPERDEYVAHMKKEHGKSVKKFPCRLCERSFCSAPSLRRHVRVNHEGIKRVYPCSPSSEARALAFGLCRCCHPVLSHFRYCTEGKRTFSSRLILEKHVQVRHGLQLGAQSPGRGTTLARGSSARAQGPGRKRRQSSDSCSEEPDSTTPPAKSPRGGPGSGGHGPLRYRSSSSTEQSLMMGLRVEDGAQQCLDCGLCFASPGSLSRHRFISHKKRRGVGKASALGLGDGEEEAPPSRSDPDGGDSPLPASGGPLTCKVCGKSCDSPLNLKTHFRTHGMAFIRARQGAVGDN

SEQ ID NO: 797976 - protein, 573 aa, Homo sapiens
LPNSAGQADLQVRHVRHSLHSQTPPLLTLRPALACPGATSNVCPTCPMMLPNRCSFSAHQRMHKNRPPHVCPECGGNFLQANFQTHLREACLHVSRRVGYRCPSCSVVFGGVNSIKSHIQTSHCEVFHKCPICPMAFKSGPSAHAHLYSQHPSFQTQQAKLIYKCAMCDTVFTHKPLLSSHFDQHLLPQRVSVFKCPSCPLLFAQKRTMLEHLKNTHQSGRLEETAGKGAGGALLTPKTEPEELAVSQGGAAPATEESSSSSEEEEVPSSPEPPRPAKRPRRELGSKGLKGGGGGPGGWTCGLCHSWFPERDEYVAHMKKEHGKSVKKFPCRLCERSFCSAPSLRRHVRVNHEGIKRVYPCRYCTEGKRTFSSRLILEKHVQVRHGLQLGAQSPGRGTTLARGSSARAQGPGRKRRQSSDSCSEEPDSTTPPAKSPRGGPGSGGHGPLRYRSSSSTEQSLMMGLRVEDGAQQCLDCGLCFASPGSLSRHRFISHKKRRGVGKASALGLGDGEEEAPPSRSDPDGGDSPLPASGGPLTCKVCGKSCDSPLNLKTHFRTHGMAFIRARQGAVGDN

SEQ ID NO: 797977 - protein, 332 aa, Homo sapiens
MGDMKTPDFDDLLAAFDIPDIDANEAIHSGPEENEGPGGPGKPEPGVGSESEDTAAASAGDGPGVPAQASDHGLPPPDISVVSVIVKNTVCPEQSEALAGGSAGDGAQAAGVTKEGPVGPHRMQNGFGSPEPSLPGTPHSPAPPSGGTWKEKGMEGKTPLDLFAHFGPEPGDHSDPLPPSAPSPTREGALTPPPFPSSFELAQENGPGMQPPVSSPPLGALKQESCSPHHPQVLAQQGSGSSPKATDIPASASPPPVAGVPFFKQSPGHQSPLASPKVPVCQPLKEEDDDEGPVDKSSPGSPQSPSSGAEAADEDSNDSPASSSSRPLKVRI

SEQ ID NO: 797978 - protein, 422 aa, Homo sapiens
MGDMKTPDFDDLLAAFDIPDIDANEAIHSGPEENEGPGGPGKPEPGVGSESEDTAAASAGDGPGVPAQASDHGLPPPDISVVSVIVKNTVCPEQSEALAGGSAGDGAQAAGVTKEGPVGPHRMQNGFGSPEPSLPGTPHSPAPPSGGTWKEKGMEGKTPLDLFAHFGPEPGDHSDPLPPSAPSPTREGALTPPPFPSSFELAQENGPGMQPPVSSPPLGALKQESCSPHHPQVLAQQGSGSSPKATDIPASASPPPVAGVPFFKQSPGHQSPLASPKVPVCQPLKEEDDDEGPVDKSSPGSPQSPSSGAEAADEDSNDSPASSSSRPLKVRIKTIKTSCGNITRTVTQVPSDPDPPAPLAEGAFLAEASLLKLSPATPTSEGPKVVSLVGLGPGDDGGCSSPASRPPMVGKKQVAACLGHSP

SEQ ID NO: 797979 - protein, 106 aa, Homo sapiens
GSRPTWRTDSQPAPGLSLARSRAGTRAVGAQGPSALRPAHRGSQGRRAGAFSCLSQQLRAAPPGLASCPSQGEGGHRNVAAALICEFQSRARLFLNYKLIDGPHLN

SEQ ID NO: 797980 - protein, 317 aa, Homo sapiens
MKSDCMQTTICQERKKDPIEMFHSGQLVKVCAPMVRYSKLAFRTLVRKYSCDLCYTPMIVAADFVKSIKARDSEFTTNQGDCPLIVQFAANDARLLSDAARIVCPYANGIDINCGCPQRWAMAEGYGACLINKPELVQDMVKQVRNQVETPGFSVSIKIRIHDDLKRTVDLCQKAEATGVSWITVHGRTAEERHQPVHYDSIKIIKENMSIPVIANGDIRSLKEAENVWRITGTDGVMVARGLLANPAMFAGYEETPLKCIWDWVDIALELGTPYMCFHQHLMYMMEKITSRQEKRVFNALSSTSAIIDYLTDHYGI

SEQ ID NO: 797981 - protein, 98 aa, Homo sapiens
GSRPTWRTDSQPAPGLSLARSRAGTRAVGAQGPSALRPAHRGSQGRRAGAFSCLSQQLRAAPPGLASCPSQGEGGHRNVAAALICEASIKPQNRGRAA

SEQ ID NO: 797982 - protein, 196 aa, Homo sapiens
MAEGYGACLINKPELVQDMVKQVRNQVETPGFSVSIKIRIHDDLKRTVDLCQKAEATGVSWITVHGRTAEERHQPVHYDSIKIIKENMSIPVIANGDIRSLKEAENVWRITGTDGVMVARGLLANPAMFAGYEETPLKCIWDWVDIALELGTPYMCFHQHLMYMMEKITSRQEKRVFNALSSTSAIIDYLTDHYGI

SEQ ID NO: 797983 - protein, 196 aa, Homo sapiens; identical to SEQ ID NO: 797982

SEQ ID NO: 797984 - protein, 106 aa, Homo sapiens; identical to SEQ ID NO: 797979

SEQ ID NO: 797985 - protein, 98 aa, Homo sapiens; identical to SEQ ID NO: 797981

SEQ ID NO: 797986 - protein, 98 aa, Homo sapiens; identical to SEQ ID NO: 797981

SEQ ID NO: 797987 - protein, 105 aa, Homo sapiens
SEVFHPQAARSEQEMGSHFVTQAGLKLLASSDLLALVSQSAGITGLNYCTRLTFPISNVSMKNTRSQLQRHPAISSILHFAKSYLWQSLHEQDWYPYKRSPRELS

SEQ ID NO: 797988 - protein, 337 aa, Homo sapiens
MLFSALLLEVIWILAADGGQHWTYEGPHGQDHWPASYPECGNNAQSPIDIQTDSVTFDPDLPALQPHGYDQPGTEPLDLHNNGHTVQLSLPSTLYLGGLPRKYVAAQLHLHWGQKGSPGGSEHQINSEATFAELHIVHYDSDSYDSLSEAAERPQGLAVLGILIEVGETKNIAYEHILSHLHEVRHKDQKTSVPPFNLRELLPKQLGQYFRYNGSLTTPPCYQSVLWTVFYRRSQISMEQLEKLQGTLFSTEEEPSKLLVQNYRALQPLNQRMVFASFIQAGSSYTTGEMLSLGVGILVGCLCLLLAVYFIARKIRKKRLENRKSVVFTSAQATTEA

SEQ ID NO: 797989 - protein, 337 aa, Homo sapiens; identical to SEQ ID NO: 797988

SEQ ID NO: 797990 - protein, 120 aa, Homo sapiens
MPPETQPDQKMCVPTRKKACLCLHALPLPFLTTYKYSLSEEVREEGGGPCLAFLRLSSIPSRSSSERGAAVNCDNCYALALKTWQVGDGGGDCDLTESSRGQGGTQGHSTGSPRAPRHEV

SEQ ID NO: 797991 - protein, 261 aa, Homo sapiens
MEEPQLLRIVLPGGQDQVVARQAQGALDSRVERPVQHHIVHPRGLNQLRKLHAPPAAGAREPSPAQGPPLPLGSGSRVGKRRAVGESRLRIRFHALAARTPSGSGYSLLEPTTTPGGSSRSRNSEDAEVAAGSWSSLGPLEMPPETQPDQKMCVPTRKKACLCLHALPLPFLTTYKYSLSEEVREEGGGPCLAFLRLSSIPSRSSSERGAAVNCDNCYALALKTWQVGDGGGDCDLTESSRGQGGTQGHSTGSPRAPRHEV

SEQ ID NO: 797992 - protein, 120 aa, Homo sapiens; identical to SEQ ID NO: 797990

SEQ ID NO: 797993 - protein, 561 aa, Homo sapiens
GCRIRTREHIRTPKVENVRLVDRVSPKKAALGTLYLTATHVIFVENSPDARKETWILHSQISTIEKQATTATGCPLLIRCKNFQIIQLIIPQERDCHDVYISLIRLARPVKYEELYCFSFNPMLDKEEREQGWVLIDLSEEYTRMGLPNHYWQLSDVNRDYRVCDSYPTELYVPKSATAHIIVGSSKFRSRRRFPVLSYYYKDNHASICRSSQPLSGFSARCLEDEQMLQAIRKANPGSDFVYVVDTRPKLNAMANRAAGKGYENEDNYSNIKFQFIGIENIHVMRNSLQKMLEVCELKSPSMSDFLWGLENSGWLRHIKAIMDAGIFIAKAVSEEGASVLVHCSDGWDRTAQVCSVASLLLDPHYRTLKGFMVLIEKDWISFGHKFNHRYGNLDGDPKEISPVIDQFIECVWQLMEQFPCAFEFNERFLIHIQHHIYSCQFGNFLCNSQKERRELKIQERTYSLWAHLWKNRADYLNPLFRADHSQTQGTLHLPTTPCNFMYKFWSGMYNRFEKGMQPRQSVTDYLMAVKEETQQLEEELEALEEVRHTCFVNLFSVLIS

SEQ ID NO: 797994 - protein, 666 aa, Homo sapiens
GCRIRTREHIRTPKVENVRLVDRVSPKKAALGTLYLTATHVIFVENSPDARKETWILHSQISTIEKQATTATGCPLLIRCKNFQIIQLIIPQERDCHDVYISLIRLARPVKYEELYCFSFNPMLDKEEREQGWVLIDLSEEYTRMGLPNHYWQLSDVNRDYRVCDSYPTELYVPKSATAHIIVGSSKFRSRRRFPVLSYYYKDNHASICRSSQPLSGFSARCLEDEQMLQAIRKANPGSDFVYVVDTRPKLNAMANRAAGKGYENEDNYSNIKFQFIGIENIHVMRNSLQKMLEVCELKSPSMSDFLWGLENSGWLRHIKAIMDAGIFIAKAVSEEGASVLVHCSDGWDRTAQVCSVASLLLDPHYRTLKGFMVLIEKDWISFGHKFNHRYGNLDGDPKEISPVIDQFIECVWQLMEQFPCAFEFNERFLIHIQHHIYSCQFGNFLCNSQKERRELKIQERTYSLWAHLWKNRADYLNPLFRADHSQTQGTLHLPTTPCNFMYKFWSGMYNRFEKGMQPRQSVTDYLMAVKEETQQLEEELEALEERLEKIQKVQLNCTKVKSKQSEPSKHSGFSTSDNSIANTPQDYSGNMKSFPSRSPSQGDEDSALILTQDNLKSSDPDLSANSDQESGVEDLSCRSPSGGEHAPSEDSGKDRDSDEAVFLTA

SEQ ID NO: 797995 - protein, 102 aa, Homo sapiens
MVLHPDHTLPSPAATLPISPQTKVTVASSPGASKWKDKALSMSSFSSQPRRSRSVFSNQAPTWRGPQGKVTGRTLAASWAWLSRAGSAPTRLALESLSFSKG

SEQ ID NO: 797996 - protein, 135 aa, Homo sapiens
MMDETFSKTAFLAGEGLFTLSLNIRFKNLIPVDSLVVMDVELDKIEDQKLYMSCIAHSSWKKSLPSNSHCACRRATASPACLLPPASPACLLPPASPACLLPPASPACLGPIKEQGGVLKQQLVRRGKGPFSLSK

SEQ ID NO: 797997 - protein, 328 aa, Homo sapiens
EAAPSAAESTPWESAKTLHPSRAGSLHLAMIRRCFQVAARLGHHRGLLEAPRILPRLNPASAFGSSTDSMFSRFLPEKTDLKDYALPNASWCSDMLSLYQEFLEKTKSSGWIKLPSFKSNRDHIRGLKLPSGLAVSSDKGDCRIFTRCIQVEGQGFEYVIFFQPTQKKSVCLFQPGSYLEGPPGFAHGGSLAAMMDETFSKTAFLAGEGLFTLSLNIRFKNLIPVDSLVVMDVELDKIEDQKLYMSCIAHSSWKKSLPSNSHCACRRATASPACLLPPASPACLLPPASPACLLPPASPACLGPIKEQGGVLKQQLVRRGKGPFSLSK

SEQ ID NO: 797998 - protein, 95 aa, Homo sapiens
IRPILDPYSSSFPSANRTWWVAGPSVIRDHGSAKKNTGFLKPEATDLRRERGSNVSSSFLFRFRFYFLVTRPPKKVPPNGQSIRRSDSLFPERRV

SEQ ID NO: 797999 - protein, 90 aa, Homo sapiens
LTLLVYTYCQRYQQQSHDATVIHPVSPAPLNTSITNHINKLDKYDSVEAIKAFNKNNLILEERNKYFNPHLTGKTYSNAYFTDLNNYDEY

SEQ ID NO: 798000 - protein, 326 aa, Homo sapiens
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRYKMVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 798001 - protein, 326 aa, Homo sapiens; identical to SEQ ID NO: 798000

SEQ ID NO: 798002 - protein, 258 aa, Homo sapiens
MHLPTHRALEEEGAPLRGPWRPGVPQRGLSRQLGGRSSHSALLSPRYKMVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 798003 - protein, 326 aa, Homo sapiens; identical to SEQ ID NO: 798000

SEQ ID NO: 798004 - protein, 326 aa, Homo sapiens; identical to SEQ ID NO: 798000

SEQ ID NO: 798005 - protein, 326 aa, Homo sapiens; identical to SEQ ID NO: 798000

SEQ ID NO: 798006 - protein, 326 aa, Homo sapiens; identical to SEQ ID NO: 798000

SEQ ID NO: 798007 - protein, 91 aa, Homo sapiens
MPGTVATLRFQLLPPEPDDAFWGAPCEQPLERRYQALPALVCIMCCLFGVVYCFFGEIPISSLTWAPQCFPEFFFWAPKSSLNPSTIMNNS

SEQ ID NO: 798008 - protein, 601 aa, Homo sapiens
LPPRRAEPAARAESPEPRLDSPPAAALGCAGFLRSALEPQPRPQLSDVSLQGPRPRGGVSGSRYRRGRRRGRLKGKDPRKCPLLSAGEGDAGGGVPCLPRRGWCVPGDVRSSPPLPGWCALSDVRSRGRSCPSAPKAAGGLRAWGRGSGAARAPAPAPSPSSGPARVPGRRGTGVPAGVGRGAAPPPRRHHSLRPSSPLPRTTDFPWTPVSWSLWRPATPAPRASAQPLSLRSSGRLQPSTMPGTVATLRFQLLPPEPDDAFWGAPCEQPLERRYQALPALVCIMCCLFGVVYCFFGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLLSLMGVLVQWRVTAEGDSHTEVVISRQRRRVQLMRIRQQEDRKEKRRKKRPPRAPLRGPRAPPRPGPPDPAYRRRPVPIKRFNGDVLSPSYIQSFRDRQTGSSLSSFMASPTDADYEYGSRGPLTACSGPPVRV

SEQ ID NO: 798009 - protein, 590 aa, Homo sapiens
LPPRRAEPAARAESPEPRLDSPPAAALGCAGFLRSALEPQPRPQLSDVSLQGPRPRGGVSGSRYRRGRRRGRLKGKDPRKCPLLSAGEGDAGGGVPCLPRRGWCVPGDVRSSPPLPGWCALSDVRSRGRSCPSAPKAAGGLRAWGRGSGAARAPAPAPSPSSGPARVPGRRGTGVPAGVGRGAAPPPRRHHSLRPSSPLPRTTDFPWTPVSWSLWRPATPAPRASAQPLSLRSSGRLQPRLTWEGDSLLFPALCRGLWQHCGSSCCPLSQMMPSGVHLVNSPWSAGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLLSLMGVLVQWRVTAEGDSHTEVVISRQRRRVQLMRIRQQEDRKEKRRKKRPPRAPLRGPRAPPRPGPPDPAYRRRPVPIKRFNGDVLSPSYIQSFRDRQTGSSLSSFMASPTDADYEYGSRGPLTACSGPPVRV

SEQ ID NO: 798010 - protein, 360 aa, Homo sapiens
MPGTVATLRFQLLPPEPDDAFWGAPCEQPLERRYQALPALVCIMCCLFGVVYCFFGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLLSLMGVLVQWRVTAEGDSHTEVVISRQRRRVQLMRIRQQEDRKEKRRKKRPPRAPLRGPRAPPRPGPPDPAYRRRPVPIKRFNGDVLSPSYIQSFRDRQTGSSLSSFMASPTDADYEYGSRGPLTACSGPPVRV

SEQ ID NO: 798011 - protein, 382 aa, Homo sapiens
MVMFAFPLTTNSHISLTSPDLNGPITDAVMTPVTLNSLILVSLSLVPLGSHVLDPLDLLPPAWCPHLGPSLAPVPPPGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLLSLMGVLVQWRVTAEGDSHTEVVISRQRRRVQLMRIRQQEDRKEKRRKKRPPRAPLRGPRAPPRPGPPDPAYRRRPVPIKRFNGDVLSPSYIQSFRDRQTGSSLSSFMASPTDADYEYGSRGPLTACSGPPVRV

SEQ ID NO: 798012 - protein, 360 aa, Homo sapiens; identical to SEQ ID NO: 798010

SEQ ID NO: 798013 - protein, 360 aa, Homo sapiens; identical to SEQ ID NO: 798010

SEQ ID NO: 798014 - protein, 360 aa, Homo sapiens; identical to SEQ ID NO: 798010

SEQ ID NO: 798015 - protein, 288 aa, Homo sapiens
MPGTVATLRFQLLPPEPDDAFWGAPCEQPLERRYQALPALVCIMCCLFGVVYCFFGYRCFKAVLFLTGLLFGSVVIFLLCYRERVLETQLSAGASAGIALGIGLLCGLVAMLVRSVGLFLVGLLLGLLLAAAALLGSAPYYQPGSVWGPLGLLLGGGLLCALLTLRWPRPLTTLATAVTGAALIATAADYFAELLLLGRYVVERLRAAPVPPLCWRSWALLALWPLLSLMGVLVQWRVTAEGDSHTEVVISRQRRRVQLMRIRQQEDRKEKRRKKRPLTACSGPPVRV

SEQ ID NO: 798016 - protein, 246 aa, Homo sapiens
MSTCCTSVPRSQPRPSCLSVFWDLYCAAPDRREACEHSGEAKAFQDYSAAAAPSPVMGSMAPGDTMAAGSMAAGFFQPFMSPRFPGGPRPTLRMPSQSYGGGMRPPPNSLAGPGLPAMNMGPGVRGPWASPSGNSIPYSSSFPGSYTGTPGGWLGPLGTPIMPSPWRIPPNTERNSMFTYSCNPQFVDKDARSGALSFPRLRAPCPWEGAPSGRPRSREWGRHHSTVKRDPVWTRVDIERPCRKVP

SEQ ID NO: 798017 - protein, 387 aa, Homo sapiens
MYAKGGKGSAVPSDSQAREKLALYVYEYLLHIGAQKSAQTFLSEIRWEKNITLGEPPGFLHSWWCVFWDLYCAAPDRREACEHSGEAKAFQDYSAAAAPSPVMGSMAPGDTMAAGSMAAGFFQPFMSPRFPGGPRPTLRMPSQPPAGLPGSQPLLPGAMEPSPRAQGHPSMGGPMQRVTPPRGMASVGPQSYGGGMRPPPNSLAGPGLPAMNMGPGVRGPWASPSGNSIPYSSSSPGSYTGPPGGGGPPGTPIMPSPGDSTNSSENMYTIMNPIGQGAGRANFPLGPGPEGPMAAMSAMEPHHVNGSLGSGDMDGLPKSSPGAVAGLSNAPGTPRDDGEMAAAGTFLHPFPSESVSDCVDSPPAAASGRRGLAGRPRRGGRGARARP

SEQ ID NO: 798018 - protein, 387 aa, Homo sapiens; identical to SEQ ID NO: 798017

SEQ ID NO: 798019 - protein, 385 aa, Homo sapiens
MGLSAVVPAAGYTFAVWSAMLSVAANVCGWVYNNVGGRLHLRLALYVYEYLLHIGAQKSAQTFLSEIRWEKNITLGEPPGFLHSWWCVFWDLYCAAPDRREACEHSGEAKAFQDYSAAAAPSPVMGSMAPGDTMAAGSMAAGFFQPFMSPRFPGGPRPTLRMPSQPPAGLPGSQPLLPGAMEPSPRAQGHPSMGGPMQRVTPPRGMASVGPQSYGGGMRPPPNSLAGPGLPAMNMGPGVRGPWASPSGNSIPYSSSSPGSYTGPPGGGGPPGTPIMPSPGDSTNSSENMYTIMNPIGQGAGRANFPLGPGPEGPMAAMSAMEPHHVNGSLGSGDMDGLPKSSPGAVAGLSNAPGTPRDDGEMAAAGTFLHPFPSESYSPGMTMSV

SEQ ID NO: 798020 - protein, 387 aa, Homo sapiens; identical to SEQ ID NO: 798017

SEQ ID NO: 798021 - protein, 261 aa, Homo sapiens
MGSMAPGDTMAAGSMAAGFFQPFMSPRFPGGPRPTLRMPSQPPAGLPGSQPLLPGAMEPSPRAQGHPSMGGPMQRVTPPRGMASVGPQSYGGGMRPPPNSLAGPGLPAMNMGPGVRGPWASPSGNSIPYSSSSPGSYTGPPGGGGPPGTPIMPSPGDSTNSSENMYTIMNPIGQGAGRANFPLGPGPEGPMAAMSAMEPHHVNGSLGSGDMDGLPKSSPGAVAGLSNAPGTPRDDGEMAAAGTFLHPFPSESYSPGMTMSV

SEQ ID NO: 798022 - protein, 297 aa, Homo sapiens
MYAKGGKGSAVPSDSQAREKLALYVYEYLLHIGAQKSAQTFLSEIRWEKNITLGEPPGFLHSWWCVFWDLYCAAPDRREACEHSGEAKAFQDYSAAAAPSPVMGSMAPGDTMAAGSMAAGFFQPFMSPRFPGGPRPTLRMPSQPPAGLPGSQPLLPGAMEPSPRAQGHPSMGGPMQRVTPPRGMASVGPQHERDGASPRERIPGLGRHGRVAEEFPRRRGRPEQRPGHPAGRRRDGGRRDLPAPVPERKRKRLRRLPPRGGVGPEGPGGQAPAGRPGGQSKTVTAAGQYSPGMTMSV

SEQ ID NO: 798023 - protein, 330 aa, Homo sapiens
MYAKGGKGSAVPSDSQAREKLALYVYEYLLHIGAQKSAQTFLSEIRWEKNITLGEPPGFLHSWWCVFWDLYCAAPDRREACEHSGEAKAFQDYSAAAAPSPVMGSMAPGDTMAAGSMAAGFFQPFMSPRFPGGPRPTLRMPSQPPAGLPGSQPLLPGAMEPSPRAQGHPSMGGPMQRVTPPRGMASVGPQSYGGGMRPPPNSLAGPGLPAMNMGPGVRGPWASPSGNSIPYSSSSPGSYTGPPGGGGPPGTPIMPSPGDSTNSSENMYTIMNPIGQGAGRANFPLGPGPEGPMAAMSAMEPHHVNGSLGSGDMDGLPKVRRLRSCRGWDP

SEQ ID NO: 798024 - protein, 133 aa, Homo sapiens
AFPGTARAEEREEKKPPCGRGRSWSRRCRRRRGRLELPRADDACRARLGLGAVRPGARGSYGDGKRGPRRRLTGVGPGGGGVEQHVRQGGQGFGRALRQPGPREVSAGPGAGLGVRALPWAPARAGTARGTWA

SEQ ID NO: 798025 - protein, 385 aa, Homo sapiens
MYAKGGKGSAVPSDSQAREKLALYVYEYLLHIGAQKSAQTFLSEIRWEKNITLGEPPGFLHSWWCVFWDLYCAAPDRREACEHSGEAKAFQDYSAAAAPSPVMGSMAPGDTMAAGSMAAGFFQGPPGSQPSPHNPNAPMMGPHGQPFMSPRFPGGPRPTLRMPSQPPAGLPGSQPLLPGAMEPSPRAQGHPSMGGPMQRVTPPRGMASVGPQSYGGGMRPPPNSLAGPGLPAMNMGPGVRGPWASPSGNSIPYSSSSPGSYTGPPGGGGPPGTPIMPSPGDSTNSSENMYTIMNPIGQGAGRANFPLGPGPEGPMAAMSAMEPHHVNGSLGSGDMDGLPKSSPGAVAGLSNAPGTPRDDGEMAAAGTFLHPFPSESYSPGMTMSV

SEQ ID NO: 798026 - protein, 363 aa, Homo sapiens
MYAKGGKGSAVPSDSQAREKLALYVYEYLLHIGAQKSAQTFLSEIRWEKNITLGEPPGFLHSWWCVFWDLYCAAPDRREACEHSGEAKAFQDYSAAAAPSPVMGSMAPGDTMAAGSMAAGFFQPFMSPRFPGGPRPTLRMPSQPPAGLPGSQPLLPGAMEPSPRAQGHPSMGGPMQRVTPPRGMASVGPQSYGGGMRPPPNSLAGPGLPAMNMGPGVRGPWASPSGNSIPYSSSSPGSYTGPPGGGGPPGTPIMPSPGDSTNSSENMYTIMNPIGQGAGRANFPLGPGPEGPMAAMSAMEPHHVNGSLGSGDMDGLPKSSPGAVAGLSNAPGTPRDDGEMAAAGTFLHPFPSESYSPGMTMSV

SEQ ID NO: 798027 - protein, 387 aa, Homo sapiens; identical to SEQ ID NO: 798017

SEQ ID NO: 798028 - protein, 387 aa, Homo sapiens; identical to SEQ ID NO: 798017

SEQ ID NO: 798029 - protein, 401 aa, Homo sapiens
REEGSARFPEQPARRKGRKKSHPAAGAGAGAAAAAAAAAVWSSPARTMPAVPAWGSGRLALYVYEYLLHIGAQKSAQTFLSEIRWEKNITLGEPPGFLHSWWCVFWDLYCAAPDRREACEHSGEAKAFQDYSAAAAPSPVMGSMAPGDTMAAGSMAAGFFQPFMSPRFPGGPRPTLRMPSQPPAGLPGSQPLLPGAMEPSPRAQGHPSMGGPMQRVTPPRGMASVGPQSYGGGMRPPPNSLAGPGLPAMNMGPGVRGPWASPSGNSIPYSSSSPGSYTGPPGGGGPPGTPIMPSPGDSTNSSENMYTIMNPIGQGAGRANFPLGPGPEGPMAAMSAMEPHHVNGSLGSGDMDGLPKSSPGAVAGLSNAPGTPRDDGEMAAAGTFLHPFPSESYSPGMTMSV

SEQ ID NO: 798030 - protein, 83 aa, Homo sapiens
WCPPWPSPGPGTEGGLWGGSLGPVELCISWISFPGAEAAGLRESPLRWKVLPPTETPANSECHTVASGDPCGPEPFAHRQGGC

SEQ ID NO: 798031 - protein, 83 aa, Homo sapiens; identical to SEQ ID NO: 798030

SEQ ID NO: 798032 - protein, 288 aa, Homo sapiens
MDAELAEVRALQAEIAALRRACEDPPAPWEEKSRVQKSFQAIHQFNLEGWKSSKDLKNQLGHLESELSFLSTLTGINIRNHSKQTEDLTSTEMTEKSIRKVLQRHRLSGNCHMVTFQLEFQILEIQNKERLSSAVTDLNIIMEPTECSELSEFVSRAEERKDLFMFFRSLHFFVEWFEYRKRTFKHLKEKYPDAVYLSEGPSSCSMGIRSASRPGFELVIVWRIQIDEDGKVFPKLDLLTKVPQRALELDKNRAIETAPLSFRTLVGLLGIEAALESLIKSLCAEENN

SEQ ID NO: 798033 - protein, 1049 aa, Homo sapiens
QAEFAAASTTPALGSDGVRVTMDSALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKKLLQFYAETCPAPQRGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEDSNAQVTTENQLKYLTRLLSVEGSTLREALTHRKIIAKGEELLSPLNLEQAAYARNALAKAVYSRTFTWLVGKINRSLASKDVESPSWRSTTVLGLLDIYGFEVFQHNSFEQFCINYCNEKLQQLFIELPLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFILRHAPRCPENAFFLDHVRTSFLLNLRRQLPRNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 798034 - protein, 1049 aa, Homo sapiens; identical to SEQ ID NO: 798033

SEQ ID NO: 798035 - protein, 1049 aa, Homo sapiens; identical to SEQ ID NO: 798033

SEQ ID NO: 798036 - protein, 1049 aa, Homo sapiens; identical to SEQ ID NO: 798033

SEQ ID NO: 798037 - protein, 153 aa, Homo sapiens
RPTPGARLVALAVVFHNRHRILNGLRAQGLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 798038 - protein, 1049 aa, Homo sapiens; identical to SEQ ID NO: 798033

SEQ ID NO: 798039 - protein, 1049 aa, Homo sapiens; identical to SEQ ID NO: 798033

SEQ ID NO: 798040 - protein, 1049 aa, Homo sapiens; identical to SEQ ID NO: 798033

SEQ ID NO: 798041 - protein, 1049 aa, Homo sapiens; identical to SEQ ID NO: 798033

SEQ ID NO: 798042 - protein, 1049 aa, Homo sapiens; identical to SEQ ID NO: 798033

SEQ ID NO: 798043 - protein, 1049 aa, Homo sapiens; identical to SEQ ID NO: 798033

SEQ ID NO: 798044 - protein, 1049 aa, Homo sapiens; identical to SEQ ID NO: 798033

SEQ ID NO: 798045 - protein, 102 aa, Homo sapiens [sequence omitted]

SEQ ID NO: 798046 - protein, 736 aa, Homo sapiens
MRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 798047 - protein, 736 aa, Homo sapiens; identical to SEQ ID NO: 798046

SEQ ID NO: 798048 - protein, 760 aa, Homo sapiens
MKLNVDGLLVYFPYDYIYPEQFSYMRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 798049 - protein, 736 aa, Homo sapiens; identical to SEQ ID NO: 798046

SEQ ID NO: 798050 - protein, 715 aa, Homo sapiens
MRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMLLIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 798051 - protein, 704 aa, Homo sapiens
KEKYLGWYEAWVVLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 798052 - protein, 710 aa, Homo sapiens
MRELKRTLDAKAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 798053 - protein, 405 aa, Homo sapiens
MRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGQAQHCGSSRNQKRSHP

SEQ ID NO: 798054 - protein, 503 aa, Homo sapiens
MRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIGYAASGAGFCGFQ

SEQ ID NO: 798055 - protein, 318 aa, Homo sapiens
LVLDRDLELVSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 798056 - protein, 102 aa, Homo sapiens [sequence omitted]

SEQ ID NO: 798057 - protein, 161 aa, Homo sapiens
TVPAGHLPQDPGLPPRHHGNLHHDAGTGLPLPYGEWERLGLGPGGEMGARGRPPSLASPTAQAGELYSEEAGFGIQTDLGLILLLCGLDSQASVFSSVKWECILPDLPGWLRGLRERTGVNHLGRPGPGTGRRLVSILASCRVRGLAVTQVSEPSSPSPSL

SEQ ID NO: 798058 - protein, 109 aa, Homo sapiens
MEHAVEEVKNSLQLFEEYFLQDKMFITGNQISLADLVAVVEMMQPMAANYNVFLNSSKLAEWRMQVELNIGSGLFREAHDRLMQLADWDFSTLDSMVKENISELLKKSR

SEQ ID NO: 798059 - protein, 69 aa, Homo sapiens
NMALELYMDLLSAPCRAVYIFSKKHDIQFNFQFVDLLKGHHHSKEYIDINPLRKLPSLKDGKFILSESC

SEQ ID NO: 798060 - protein, 123 aa, Homo sapiens
VGTQPPPPERPLCASCWETMKTHRAGLWGLRSALGETCFSGLREHSEHVLGEGRSPPTCPEDLAGSRHGMGQKGNLRGPTPTALPTNQAFNNPTLNTCSPEVLRPWAAPSSGGTGRGRGGASP

SEQ ID NO: 798061 - protein, 236 aa, Homo sapiens
MPTALFLLPPFVPFPDKRAISNNEYIWVFTGAGRRGVHFSPRGPPAKQPGSRGARGPGAGLGLRRGRLALGCGRSGIPILERRRRASGWGREGFLDPSRFSEIVKKGLNKRGGAFKKKIDSDALAGSRSTICHADSHTHRGPRDTATWDQTMRPAVWRPPCGKMPAAGPLREERMQREGKRREGPGAGQAGTSGCSACCPGGSCISAGKVRALPEPELGRLQLSPGGLAKSGHVGA

SEQ ID NO: 798062 - protein, 202 aa, Homo sapiens
MAGEKKRRHRKLVTAMNGTFWRGAEERGLGVPQTRAPGSPLPLGSVPDPRWDTASLVLPSAPWFPTALAPLAPAQSNPAQPSPAGGGRTSCWAPGKRSRTRRKSWRKVARTTAGHARTERLSALSRAPRWARSVCALCSSTSASVCGRCSPEHLRGTGRVGRGGRGQRQGHDRNSGSHSSQDTDTGDNTRVGRSTNTHADRA

SEQ ID NO: 798063 - protein, 202 aa, Homo sapiens; identical to SEQ ID NO: 798062

SEQ ID NO: 798064 - protein, 123 aa, Homo sapiens
MGAPGGKINRPRTELKKKLFKRRRVLNRERRLRHRVVGAVIDQGLITRHHLKKRASSARANITLSGKKRRKLLQQIRLAQKEKTAMEVEAPSKPARTSEPQLKRQKKTKAPQDVEMKDLEDES

SEQ ID NO: 798065 - protein, 126 aa, Homo sapiens
MFSNSKLYVTILEMRMSPVIQAYVWCDSVLVSRRALHDRHIIVRDQGLITRHHLKKRASSARANITLSGKKRRKLLQQIRLAQKEKTAMEVEAPSKPARTSEPQLKRQKKTKAPQDVEMKDLEDES

SEQ ID NO: 798066 - protein, 125 aa, Homo sapiens
FFRKESMAACTASGAPTGAPRSRKLLPRGLTTPWRRLERPIAETIDKRPAREDLLEETFGIRSAWISGLAEGVEVSKKCWHQGLSAGTLCPQFRGGIARGRVRVFMVAVGFMIAHFSVFRRFPIS

SEQ ID NO: 798067 - protein, 72 aa, Homo sapiens
SGGIRHGRTELKKKLFKRRRVLNRERRLRHRVVGAVIDQGLITRHHLKKRALISYTPVCIVIIRVYTFNAKT

SEQ ID NO: 798068 - protein, 123 aa, Homo sapiens; identical to SEQ ID NO: 798064

SEQ ID NO: 798069 - protein, 289 aa, Homo sapiens
MALVPGRSKEDGLWTRNSPGSSQHPESPRLPNPLWDRGKIGKVEGHQHIQDFSQKSHLPSIVVESSEVNEESGDLHLPHEELLLLTDGEEEDAEAFFQDQSEEPGWAWSPQDPRSPLRTFNAGLSWGQDQDEEDACWILEDTACLEATNHCPFWDSTGSRVVEVALWNIPISCLLIALRELKKKLFKRRRVLNRERRLRHRVVGAVIDQGLITRHHLKKRASSARANITLSGKKRRKLLQQIRLAQKEKTAMEVEAPSKPARTSEPQLKRQKKTKAPQDVEMKDLEDES

SEQ ID NO: 798070 - protein, 351 aa, Homo sapiens
FFRKESMAACTASGAPTGAPRSRKLLPRGLTTPWRRLERPIAETIDKRPAREDLLEETFGIRSAWISGRSKEDGLWTRNSPGSSQHPESPRLPNPLWDRGKIGKVEGHQHIQDFSQKSHLPSIVVESSEVNEESGDLHLPHEELLLLTDGEEEDAEAFFQDQSEEPGWAWSPQDPRSPLRTFNAGLSWGQDQDEEDACWILEDTACLEATNHCPFWDSTGSRVVEVALWNIPISCLLIALRELKKKLFKRRRVLNRERRLRHRVVGAVIDQGLITRHHLKKRASSARANITLSGKKRRKLLQQIRLAQKEKTAMEVEAPSKPARTSEPQLKRQKKTKAPQDVEMKDLEDES

SEQ ID NO: 798071 - protein, 190 aa, Homo sapiens
LSGSTDRELEWNRDYGSSGGKDQPAPNGDCCGGRDFVSSSVPEPFYLARDGISEGPGLPGGGAPGRGEPTPSDSHLSPRQELKKKLFKRRRVLNRERRLRHRVVGAVIDQGLITRHHLKKRASSARANITLSGKKRRKLLQQIRLAQKEKTAMEVEAPSKPARTSEPQLKRQKKTKAPQDVEMKDLEDES

SEQ ID NO: 798072 - protein, 289 aa, Homo sapiens; identical to SEQ ID NO: 798069

SEQ ID NO: 798073 - protein, 208 aa, Homo sapiens
MALVPGRSKEDGLWTRNSPGSSQHPESPRLPNPLWDRGKIGKVEGHQHIQDFSQKSHLPSIVVESSEVNEESGDLHLPHEELLLLTDGEEEDAEAFFQDQSEEPGWAWSPQDPRSPLRTFNAGLSWGQDQDEEDACWILEDTACLEATNHCPFWDSTGSRVCRSGFVEYSHLLPPNSFEGKYCSLPLKYLIQVYEAPYTHPLTISFYR

SEQ ID NO: 798074 - protein, 208 aa, Homo sapiens; identical to SEQ ID NO: 798073

SEQ ID NO: 798075 - protein, 88 aa, Homo sapiens
GYGVGLYKQGLISGTPQEAASSARANITLSGKKRRKLLQQIRLAQKEKTAMEVEAPSKPARTSEPQLKRQKKTKAPQDVEMKDLEDES

SEQ ID NO: 798076 - protein, 141 aa, Homo sapiens [sequence omitted]

SEQ ID NO: 798077 - protein, 159 aa, Homo sapiens
MKKMLVGFLRTQHVWKPPTTVPSGTQQAPVFVEVALWNIPISCLLIALRELKKKLFKRRRVLNRERRLRHRVVGAVIDQGLITRHHLKKRASSARANITLSGKKRRKLLQQIRLAQKEKTAMEVEAPSKPARTSEPQLKRQKKTKAPQDVEMKDLEDES

SEQ ID NO: 798078 - protein, 208 aa, Homo sapiens; identical to SEQ ID NO: 798073

SEQ ID NO: 798079 - protein, 208 aa, Homo sapiens; identical to SEQ ID NO: 798073

SEQ ID NO: 798080 - protein, 115 aa, Homo sapiens
SLPATRRSASTADFSTSSLTCASSFCISLTWPRQEQGRTCELSSHPTQQAPPSPRPTDPRAPQGQDLLCDAGYLHPGFCGWILKEGEAPCVTTSRLGSTLTLSPKEHLPPAAIQK

SEQ ID NO: 798081 - protein, 153 aa, Homo sapiens
MNVGVAHSEVNPNTRVMNSRGIWLAYIILVGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 798082 - protein, 153 aa, Homo sapiens; identical to SEQ ID NO: 798081

SEQ ID NO: 798083 - protein, 153 aa, Homo sapiens; identical to SEQ ID NO: 798081

SEQ ID NO: 798084 - protein, 174 aa, Homo sapiens
FGTEGRIRHEAAPIAGRGSELMNVGVAHSEVNPNTRVMNSRGIWLAYIILVGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 798085 - protein, 147 aa, Homo sapiens
RYFLETSGVVAGAAPIAGRGSELAGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 798086 - protein, 161 aa, Homo sapiens
MPKPLLALMNVGVAHSEVNPNTRVMNSRGIWLAYIILVGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 798087 - protein, 147 aa, Homo sapiens; identical to SEQ ID NO: 798085

SEQ ID NO: 798088 - protein, 174 aa, Homo sapiens
MPKPLLALMNVGVAHSEVNPNTRVMNSRGIWLAYIILVGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLNQQILRDGFWDSSMGMGKALKQRTIKHPSLILHTVFYTFKA

SEQ ID NO: 798089 - protein, 153 aa, Homo sapiens; identical to SEQ ID NO: 798081

SEQ ID NO: 798090 - protein, 174 aa, Homo sapiens; identical to SEQ ID NO: 798084

SEQ ID NO: 798091 - protein, 153 aa, Homo sapiens; identical to SEQ ID NO: 798081

SEQ ID NO: 798092 - protein, 174 aa, Homo sapiens; identical to SEQ ID NO: 798084

SEQ ID NO: 798093 - protein, 153 aa, Homo sapiens; identical to SEQ ID NO: 798081

SEQ ID NO: 798094 - protein, 598 aa, Homo sapiens
TCPASGAPAALVPGAAGDHSPPLRRLHPRPPPGRASGAPAPSPWTRRPRCAGRRRGRKMAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLDLDIPMSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREKMEKRTAHEKEKYQPSYDTTILTEMRLEPIIEDAVEHEQKKSSKRTLPADYGDSLAKRGSCSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRSVRPRLTIYVCREQPSSTVLQGQQQAASSASENGSGAPYVYHAIYLEEMIASEVARKLALVFNIPLHQINQVYRQGPTGIHILVSDQMVQNFQDESCFLFSTVKAESSDGIHIILK

SEQ ID NO: 798095 - protein, 102 aa, Homo sapiens
TDLPRSIRIACCWEVSCFKSSLYGTILCPLMRWFSMSLSSKELKKPLLRRPPSCSSFLKASERRPGWEKDLRMGLRTGSWLPVGAAWGGLGRGLSDPRLPLT

SEQ ID NO: 798096 - protein, 145 aa, Homo sapiens
AKGYLLKIFLQCYFFGVRTDEVNFRLANREEHSSIFLDICGLHNIVSANEVVLNVALLEGAEEAAASEAPILQLLPKGQRAQAGLGEGLAHGPAHRLLAPCGRGMGRVGAGALGPPAAADVIELLDALVDQGRRSLLVRHRHAAA

SEQ ID NO: 798097 - protein, 141 aa, Homo sapiens
SLHKADFLLKAYGRLGLCTSWVIFYREEHSSIFLDICGLHNIVSANEVVLNVALLEGAEEAAASEAPILQLLPKGQRAQAGLGEGLAHGPAHRLLAPCGRGMGRVGAGALGPPAAADVIELLDALVDQGRRSLLVRHRHAA

SEQ ID NO: 798098 - protein, 481 aa, Homo sapiens
MALSYRVSELQSTIPEHILQSTFVHVISSNWSGLQTESIPEEMKQIVEEQGNKLHWAALLILMVIIPTIGGNTLVILAVSLEKKLQYATNYFLMSLAVADLLVGLFVMPIALLTIMFEAMWPLPLVLCPAWLFLDVLFSTASIMHLCAISVDRYIAIKKPIQANQYNSRATAFIKITVVWLISIGIAIPVPIKGIETDVDNPNNITCVLTKERFGDFMLFGSLAAFFTPLAIMIVTYFLTIHALQKKAYLVKNKPPQRLTWLTVSTVFQRDETPCSSPEKVAMLDGSRKDKALPNSGDETLMRRTSTIGKKSVQTISNEQRASKVLGIVFFLFLLMWCPFFITNITLVLCDSCNQTTLQMLLEIFVWIGYVSSGVNPLVYTLFNKTFRDAFGRYITCNYRATKSVKTLRKRSSKIYFRNPMAENSKFFKKHGIRNGINPAMYQSPMRLRSSTIQSSSIILLDTLLLTENEGDKTEEQVSYV

SEQ ID NO: 798099 - protein, 67 aa, Homo sapiens
AKKAAMSPLQARHSAGAMARRTRRGAAPKVKALLQVPLTSSHFRAASRGRGILPEEPESQLCQVLAV

SEQ ID NO: 798100 - protein, 71 aa, Homo sapiens
DPPGPAKFLKVVSLPCPGVPGHRNQDSPAHPESFRAPLKYESELLDGNPGATTCPMVAMGKSLNLPDPVFS

SEQ ID NO: 798101 - protein, 686 aa, Homo sapiens
MGPRSRERRAGAVQNTNDSSALSKRSLAARGYVQDPFAALLVPGAARRAPLIHRGYYVRARAVRHCVRAFLEQIGAPQAALRAQILSLGAGFDSLYFRLKTAGRLARAAVWEVDFPDVARRKAERIGETPELCALTGPFERGEPASALCFESADYCILGLDLRQLQRVEEALGAAGLDAASPTLLLAEAVLTYLEPESAAALIAWAAQRFPNALFVVYEQMRPQDAFGQFMLQHFRQLNSPLHGLERFPDVEAQRRRFLQAGWTACGAVDMNEFYHCFLPAEERRRVENIEPFDEFEEWHLKCAHYFILAASRGDTLSHTLVFPSSEAFPRVNPASPSGVFPASVVSSEGQVPNLKRYGHASVFLSPDVILSAGGFGEQEGRHCRVSQFHLLSRDCDSEWKGSQIGSCGTGVQWDGRLYHTMTRLSESRVLVLGGRLSPVSPALGVLQLHFFKSEDNNTEDLKVTITKAGRKDDSTLCCWRHSTTEVSCQNQEYLFVYGGRSVVEPVLSDWHFLHVGTMAWVRIPVEGEVPEARHSHSACTWQGGALIAGGLGASEEPLNSVLFLRPISCGFLWESVDIQPPITPRYSHTAHVLNGKLLLVGGIWIHSSSFPGVTVINLTTGLSSEYQIDTTYVPWPLMLHNHTSILLPEEQQLLLLGGGGNCFSFGTYFNPHTVTLDLSSLSAGQ

SEQ ID NO: 798102 - protein, 660 aa, Homo sapiens
RSFTEATTSAHARGYVQDPFAALLVPGAARRAPLIHRGYYVRAFLEQIGAPQAALRAQILSLGAGFDSLYFRLKTAGRLARAAVWEVDFPDVARRKAERIGETPELCALTGPFERGEPASALCFESADYCILGLDLRQLQRVEEALGAAGLDAASPTLLLAEAVLTYLEPESAAALIAWAAQRFPNALFVVYEQMRPQDAFGQFMLQHFRQLNSPLHGLERFPDVEAQRRRFLQAGWTACGAVDMNEFYHCFLPAEERRRVENIEPFDEFEEWHLKCAHYFILAASRGDTLSHTLVFPSSEAFPRVNPASPSGVFPASVVSSEGQVPNLKRYGHASVFLSPDVILSAGGFGEQEGRHCRVSQFHLLSRDCDSEWKGSQIGSCGTGVQWDGRLYHTMTRLSESRVLVLGGRLSPVSPALGVLQLHFFKSEDNNTEDLKVTITKAGRKDDSTLCCWRHSTTEVSCQNQEYLFVYGGRSVVEPVLSDWHFLHVGTMAWVRIPVEGEVPEARHSHSACTWQGGALIAGGLGASEEPLNSVLFLRPISCGFLWESVDIQPPITPRYSHTAHVLNGKLLLVGGIWIHSSSFPGVTVINLTTGLSSEYQIDTTYVPWPLMLHNHTSILLPEEQQLLLLGGGGNCFSFGTYFNPHTVTLDLSSLSAGQ

SEQ ID NO: 798103 - protein, 686 aa, Homo sapiens; identical to SEQ ID NO: 798101

SEQ ID NO: 798104 - protein, 151 aa, Homo sapiens
DAWVGRVGRPTRAGGGLGASEEPLNSVLFLRPISCGFLWESVDIQPPITPRYSHTAHVLNGKLLLVGGIWIHSSSFPGVTVINLTTGLSSEYQIDTTYVPWPLMLHNHTSILLPEEQQLLLLGGGGNCFSFGTYFNPHTVTLDLSSLSAGQ

SEQ ID NO: 798105 - protein, 669 aa, Homo sapiens
MGPRSRERRAGAVQNTNDSSALSKRSLAARGYVQDPFAALLVPGAARRAPLIHRGYYVRARAVRHCVRAFLEQIGAPQAALRAQILSLGAGFDSLYFRLKTAGRLARAAVWEVDFPDVARRKAERIGETPELCALTGPFERGEPASALCFESADYCILGLDLRQLQRVEEALGAAGLDAASPTLLLAEAVLTYLEPESAAALIAWAAQRFPNALFVVYEQMRPQDAFGQFMLQHFRQLNSPLHGLERFPDVEAQRRRFLQAGWTACGAVDMNEFYHCFLPAEERRRVENIEPFDEFEEWHLKCAHYFILAASRGDTLSHTLVFPSSEAFPRVNPASPSGVFPASVVSSEGQVPNLKRYGHASVFLSPDVILSAGGFGEQEGRHCRVSQFHLLSRDCDSEWKGSQIGSCGTGVQWDGRLYHTMTRLSESRVLVLGGRLSPVSPALGVLQLHFFKSEDNNTEDLKVTITKAGRKDDSTLCCWRHSTTEVSCQNQEYLFVYGGRSVVEPVLSDWHFLHVGTMAWVRIPVEGEVPEARHSHSACTWQGGALIAGGLGASEEPLNSVLFLRPISCGFLWESVDIQPPITPRYSHTAHVLNGKLLLVGGIWIHSSSFPGVTVINLTTGLSSEYQIDTTYVPWPLMLHNHTSILLPLKINNASELRVGSPGDGVCI

SEQ ID NO: 798106 - protein, 686 aa, Homo sapiens; identical to SEQ ID NO: 798101

SEQ ID NO: 798107 - protein, 372 aa, Homo sapiens
AGTGPECMGSSSEAFPRVNPASPSGVFPASVVSSEGQVPNLKRYGHASVFLSPDVILSAGGFGEQEGRHCRVSQFHLLSRDCDSEWKGSQIGSCGTGVQWDGRLYHTMTRLSESRVLVLGGRLSPVSPALGVLQLHFFKSEDNNTEDLKVTITKAGRKDDSTLCCWRHSTTEVSCQNQEYLFVYGGRSVVEPVLSDWHFLHVGTMAWVRIPVEGEVPEARHSHSACTWQGGALIAGGLGASEEPLNSVLFLRPISCGFLWESVDIQPPITPRYSHTAHVLNGKLLLVGGIWIHSSSFPGVTVINLTTGLSSEYQIDTTYVPWPLMLHNHTSILLPEEQQLLLLGGGGNCFSFGTYFNPHTVTLDLSSLSAGQ

SEQ ID NO: 798108 - protein, 685 aa, Homo sapiens
MGPRSRERRAGAVQNTNDSSALSKRSLAARGYVQDPFAALLVPGAARRAPLIHRGYYVRARAVRHCVRAFLEQIGAPQAALRAQILSLGAGFDSLYFRLKTAGRLARAAVWEVDFPDVARRKAERIGETPELCALTGPFERGEPASALCFESADYCILGLDLRQLQRVEEALGAAGLDAASPTLLLAEAVLTYLEPESAAALIAWAAQRFPNALFVVYEQMRPQDAFGQFMLQHFRQLNSPLHGLERFPDVEAQRRRFLQAGWTACGAVDMNEFYHCFLPAEERRRVENIEPFDEFEEWHLKCAHYFILAASRGDTLSHTLVFPSSEAFPRVNPASPSGVFPASVVSSEGQVPNLKRYGHASVFLSPDVILSAGGFGEQEGRHCRVSQFHLLSRDCDSEWKGSQIGSCGTGVQWDGRLYHTMTRLSESRVLVLGGRLSPVSPALGVLQLHFFKSEDNNTEDLKVTITKAGRKDDSTLCCWRHSTTEVSCQNQEYLFVYGGRSVVEPVLSDWHFLHVGTMAWVRIPVEGEVPEARHSHSACTWQGGALIAGGLGASEEPLNSVLFLRPISCGFLWESVDIQPPITPRYSHTAHVLNGKLLLVGGIWIHSSSFPGVTVINLTTGLSSEYQIDTTYVPWPLMLHNHTSILLPEEQQLLLLGGGGNCFSFGTYFNPHTVTATFPDRLDC

SEQ ID NO: 798109 - protein, 462 aa, Homo sapiens
LSRLEAVTARSFEEEGEHLGSRKHRMSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVRDDLGFRLISEQVSHHPPISAFHAEGLNNDFIFHGSIYPKLKFWGKSVEAEPKGTITLELLEHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 798110 - protein, 218 aa, Homo sapiens
LSRLEAVTARSFEEEGEHLGSRKHRMSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVREEPLEFRASVPAKQGQASQPRPSQWQFQELKQLNDDFIFLTGVILQSTDVIMSEQSTVRKPCASTASYE

SEQ ID NO: 798111 - protein, 462 aa, Homo sapiens; identical to SEQ ID NO: 798109

SEQ ID NO: 798112 - protein, 196 aa, Homo sapiens
MSSSRDFHVTFAPKRSLVRQPTCTEELLQTGMETASAKNSENNTKEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 798113 - protein, 565 aa, Homo sapiens
PDQDPGVTMAAPMLRWGCRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPVLNRRCVEAAVMTGLALNCHINKKSLFDRKHYFYADLPAGYQITQQRLPIAVNGSLIYGVCAGKKQSQVIPKTVRIKQIQLEQDSGKSLHDNLRSQTLIDLNRAGVGLLEVVLEPDMSCGEEAATAVRELQLILQALGTSQANMAEGQLRVDANISVHHPGEPLGVRTEVKNLNSIRFLAKAIDYEIQRQINELENGGEILNETRSFHHKLGCTMSMRDKEGKQDYRFMPEPNLPPLVLYDATSLPAGADPQQVINIDQIRETLPELPSVTREKLVQQYGMLLEHSFTLLNEVGLLEFFQNVIKETRAEPKKVTSWVLNTFLGYLKQQNLAVSESPVTPSALAELLDLLDSRTISSSAAKQVFEELWKREGKTPGQIVSEKQLELMQDQGALEQLCHSVMEAHPQVVMDVKNRNPRAINKLIGLVRKATQSRADPVMIKEILEKKLSL

SEQ ID NO: 798114 - protein, 475 aa, Homo sapiens
PDQDPGVTMAAPMLRWGCRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPVLNRRCVEAAVMTGLALNCHINKKSLFDRKHYFYADLPAGYQITQQRLPIAVNGSLIYGVCAGKKQSQVIPKTVRIKQIQLEQDSGKSLHDNLRSQTLIDLNRAGVGLLEVVLEPDMSCGEEAATAVRELQLILQALGTSQANMAEGQLRVDANISVHHPGEPLGVRTEVKNLNSIRFLAKAIDYEIQRQINELENGGEILNETRSFHHKLGCTMSMRDKEGKQDYRFMPEPNLPPLVLYDATSLPAGADPQQVINIDQIRETLPELPSVTREKLVQQYGMLLEHSFTLLNEVGLLEFFQNVIKETRAEPKKVTSWVLNTFLGYLKQQNLAVSERCLRNCGRGKARLQGRLFQKSSLN

SEQ ID NO: 798115 - protein, 565 aa, Homo sapiens; identical to SEQ ID NO: 798113

SEQ ID NO: 798116 - protein, 565 aa, Homo sapiens; identical to SEQ ID NO: 798113

SEQ ID NO: 798117 - protein, 486 aa, Homo sapiens
PDQDPGVTMAAPMLRWGCRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPVLNRRCVEAAVMTGLALNCHINKKSLFDRKHYFYADLPAGYQITQQRLPIAVNGSLIYGVCAGKKQSQVIPKTVRIKQIQLEQDSGKSLHDNLRSQTLIDLNRAGVGLLEVVLEPDMSCGEEAATAVRELQLILQALGTSQANMAEGQLRVDANISVHHPGEPLGVRTEVKNLNSIRFLAKAIDYEIQRQINELENGGEILNETRSFHHKLGCTMSMRDKEGKQDYRFMPEPNLPPLVLYDATSLPAGADPQQVINIDQIRETLPELPSVTREKLVQQYGMLLEHSFTLLNEVGLLEFFQNVIKETRAEPKKVTSWVLNTFLGYLKQQNLAVSESPVTPSALAELLDLLDSRTISSSAAKQTCTSSGTG

SEQ ID NO: 798118 - protein, 565 aa, Homo sapiens; identical to SEQ ID NO: 798113

SEQ ID NO: 798119 - protein, 123 aa, Homo sapiens
PDQDPGVTMAAPMLRWGCRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPSEDSPS

SEQ ID NO: 798120 - protein, 520 aa, Homo sapiens
PDQDPGVTMAAPMLRWGCRGRRWAFARVDGGSCHRRGAPTGSTSNQIRGESSVAQQPLHTAQKTRKGEHKWAAVVGLEIHAQISSNSKLFSGSQVRFSAPPNSLVSFFDASLPGTLPVLNRRCVEAAVMTGLALNCHINKKSLFDRKHYFYADLPAGYQITQQRLPIAVNGSLIYGVCAGKKQSQVIPKTVRIKQIQLEQDSGKSLHDNLRSQTLIDLNRAGVGLLEVVLEPDMSCGEEAATAVRELQLILQALGTSQANMAEGQLRVDANISVHHPGEPLGVRTEVKNLNSIRFLAKAIDYEIQRQINELENGGEILNETRSFHHKLGCTMSMRDKEGKQDYRFMPEPNLPPLVLYDATSLPAGADPQQVINIDQIRETLPELPSVTREKLVQQYGMLLEHSFTLLNEVGLLEFFQNVIKETRAEPKKVTSWVLNTFLGYLKQQNLAVSESPVTPSALAELLDLLDSRTISSSAAKQVMDVKNRNPRAINKLIGLVRKATQSRADPVMIKEILEKKLSL

SEQ ID NO: 798121 - protein, 332 aa, Homo sapiens [sequence omitted]

SEQ ID NO: 798122 - protein, 234 aa, Homo sapiens
MSMRDKEGKQDYRFMPEPNLPPLVLYDATSLPAGADPQQVINIDQIRETLPELPSVTREKLVQQYGMLLEHSFTLLNEVGLLEFFQNVIKETRAEPKKVTSWVLNTFLGYLKQQNLAVSESPVTPSALAELLDLLDSRTISSSAAKQVFEELWKREGKTPGQIVSEKQLELMQDQGALEQLCHSVMEAHPQVVMDVKNRNPRAINKLIGLVRKATQSRADPVMIKEILEKKLSL

SEQ ID NO: 798123 - protein, 244 aa, Homo sapiens
MLSPDQAADSDHPSSAHSDPESLGGTDTKVLGSVSDLEPVEEAEGDGKGGSRAALYPHPQQLSREEKRRRRRATAKYRSAHATRERIRVEAFNLAFAELRKLLPTLPPDKKLSKIEILRLAICYISYLNHVLDVYGRGAPRGAACPGVRETLRIRTGAVARVAEAAVAQRDGRLERRPGKKLATCSLWSAGRRGKVSDAGRWGCLASPGARRGDFPGQENLVETPEMSHFWGSPRVVVLTHWRL

SEQ ID NO: 798124 - protein, 138 aa, Homo sapiens
MILQQPLQRGPQGGAQRLPRAALGVTWGLDASSPLRGAVPMSTKRRLEEEQEPLRKQFLSEENMATHFSQLSLHNDHPYCSPPMTFSPALPPLRSPCSELLLWRYPGSLIPEALRLLRLGDTPSPPYPATPAGDIMEL

SEQ ID NO: 798125 - protein, 182 aa, Homo sapiens
MLVRAWWLIGEALRREGGWCVLAEPKSRDSSPVAQIPPAGPQNPMILQQPLQRGPQGGAQRLPRAALGVTWGLDASSPLRGAVPMSTKRRLEEEQEPLRKQFLSEENMATHFSQLSLHNDHPYCSPPMTFSPALPPLRSPCSELLLWRYPGSLIPEALRLLRLGDTPSPPYPATPAGDIMEL

SEQ ID NO: 798126 - protein, 119 aa, Homo sapiens
MILQQPLQRGPQGGAQRLPRAALGVTWGLDAREPLRKQFLSEENMATHFSQLSLHNDHPYCSPPMTFSPALPPLRSPCSELLLWRYPGSLIPEALRLLRLGDTPSPPYPATPAGDIMEL

SEQ ID NO: 798127 - protein, 155 aa, Homo sapiens
ERFLSVAPYRLRREGGWCVPSRTLGAEIPPAGPQNPMILQQPLQRGPQGGAQRLPRAALGVTWGLDAREPLRKQFLSEENMATHFSQLSLHNDHPYCSPPMTFSPALPPLRSPCSELLLWRYPGSLIPEALRLLRLGDTPSPPYPATPAGDIMEL

SEQ ID NO: 798128 - protein, 216 aa, Homo sapiens
MILQQPLQRGPQGGAQRLPRAALGVTWGLDASSPLRGAVPMSTKRRLEEEQEPLRKQFLSEENMATHFSQLSLHNDHPYCSPPMTFSPALPPLRKVPPLARPSAESQAVLTADLRPCLIVPFLALADLWVVSHLGSLESAGNPGAPGDLDLVGGAQLGQPQLHALTVISSSRSPCSELLLWRYPGSLIPEALRLLRLGDTPSPPYPATPAGDIMEL

SEQ ID NO: 798129 - protein, 138 aa, Homo sapiens; identical to SEQ ID NO: 798124

SEQ ID NO: 798130 - protein, 114 aa, Homo sapiens
MILQQPLQRGPQGGAQRLPRAALGVTWGLDASSPLRGAVPMSTKRRLEEEQEPLRKQFLSEENMATHFSQLSLHNDHPYCSPPMTFSPALPPLSHNRRDQRLPQRDKVPPSPAE

SEQ ID NO: 798131 - protein, 218 aa, Homo sapiens
SGSSPWRPTAFGAKVAAPLSRIPSPTPRSKPAFRHAPPVFRARAEPRGCARLKPRPSSLGHALRDSSPVAQIPPAGPQNPMILQQPLQRGPQGGAQRLPRAALGVTWGLDASSPLRGAVPMSTKRRLEEEQEPLRKQFLSEENMATHFSQLSLHNDHPYCSPPMTFSPALPPLRSPCSELLLWRYPGSLIPEALRLLRLGDTPSPPYPATPAGDIMEL

SEQ ID NO: 798132 - protein, 174 aa, Homo sapiens
ERFLSVAPYRLRREGGWCVPSRTLGAEIPPAGPQNPMILQQPLQRGPQGGAQRLPRAALGVTWGLDASSPLRGAVPMSTKRRLEEEQEPLRKQFLSEENMATHFSQLSLHNDHPYCSPPMTFSPALPPLRSPCSELLLWRYPGSLIPEALRLLRLGDTPSPPYPATPAGDIMEL

SEQ ID NO: 798133 - protein, 138 aa, Homo sapiens; identical to SEQ ID NO: 798124

SEQ ID NO: 798134 - protein, 160 aa, Homo sapiens
MILQQPLQRGPQGGAQRLPRAALGVTWGLDASSPLRGAVPMSTKRRLEEEQEPLRKQFLSEENMATHFSQLSLHNDHPYCSPPMTFSPALPPLRSPCSELLLWRYPGSLIPEALRLLRLGDTPSPPPQQKRPATPAKGQGSSLSCRVGIWAPRPSLNRGH

SEQ ID NO: 798135 - protein, 160 aa, Homo sapiens
MEGSPIPVLTVPTAPYEDQRPSGGGGLRRPTGLFEGQRNYLPNFIQSVLSSIDLRDRQGCTMVVGSDGRYFSRTAIEIVVQMAAANGIGRLIIGQNGILSTPAVSCIIRKIKAAGGIILTASHCPGGPGGEFGVKFNVANGGMWFSICLNNHDFFPLILL

SEQ ID NO: 798136 - protein, 166 aa, Homo sapiens
PPYQLRKAFAPERNPAKMEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLNTPQPSALECKDQNKQKEASSQAGAVSVSTPNAGL

SEQ ID NO: 798137 - protein, 177 aa, Homo sapiens
MTHTECADEEVRGVLLAMYSLLQRPPATMEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLNTPQPSALECKDQNKQKEASSQAGAVSVSTPNAGL

SEQ ID NO: 798138 - protein, 149 aa, Homo sapiens
MEKEETTRELLLPNWQGSGSHGLTIAQRDDGVFVQEVTQNSPAARTGVVKEGDQIVGATIYFDNLQSGEVTQLLNTMGHHTVGLKLHRKGDRSPEPGQTWTREVFSSCSSEVVLNTPQPSALECKDQNKQKEASSQAGAVSVSTPNAGL

SEQ ID NO: 798139 - protein, 149 aa, Homo sapiens; identical to SEQ ID NO: 798138

SEQ ID NO: 798140 - protein, 141 aa, Homo sapiens
LSASGARADANGVTDGNASETASDDPARAAPDFLGCTGAGSGDRGPRPFGSGRGLAPRPTGGRDPTRTPPRFWAAGASRRLSGTLSPGLRPLGPLACRLGGKGPWICAPPMEQRPGSERPREAAGADPPGGLGGHRGLRLA

SEQ ID NO: 798141 - protein, 139 aa, Homo sapiens
LSASGARADANGVTDGNASETASDDPARAGTGVFGWLEGPDPWGRNLGSVCPNERGGSDESVVPPLSISSGPGPRGLSERPVAADPGRASLLPVVSLYSGSGASPPFTYRSYIQKLLLGPQRGLPRLCVTPALPLWGCG

SEQ ID NO: 798142 - protein, 139 aa, Homo sapiens; identical to SEQ ID NO: 798141

SEQ ID NO: 798143 - protein, 141 aa, Homo sapiens; identical to SEQ ID NO: 798140

SEQ ID NO: 798144 - protein, 141 aa, Homo sapiens; identical to SEQ ID NO: 798140

SEQ ID NO: 798145 - protein, 356 aa, Homo sapiens
MNFEFEREIGFINSQPSLAECLTSFPAVLETFQTSSIKESTLIPPPPPFEQTFPSLQPGASTLQRPRSQKRAEDGPALPPPPPPPLPAAPPAPEFPWMKEKKSAKKPSQSATSPSPAASAVPASGVGSPADGLGLPEAGGGGARRLRTAYTNTQLLELEKEFHFNKYLCRPRRVEIAALLDLTERQVKVWFQNRRMKHKRQTQHREPPDGEPACPGALEDICDPAEEPAASPGGPSASRAAWEACCHPPEVVPGALSADPRPLAVRLEGAGASSPGCALRGAGGLEPGPLPEDVFSGRQDSPFLPDLNFFAADSCLQLSGGLSPSLQGSLDSPVPFSEEELDFFTSTLCAIDLQFP

SEQ ID NO: 798146 - protein, 241 aa, Homo sapiens
PGRGCRLERERRKPKNGLGLPEAGGGGARRLRTAYTNTQLLELEKEFHFNKYLCRPRRVEIAALLDLTERQVKVWFQNRRMKHKRQTQHREPPDGEPACPGALEDICDPAEEPAASPGGPSASRAAWEACCHPPEVVPGALSADPRPLAVRLEGAGASSPGCALRGAGGLEPGPLPEDVFSGRQDSPFLPDLNFFAADSCLQLSGGLSPSLQGSLDSPVPFSEEELDFFTSTLCAIDLQFP

SEQ ID NO: 798147 - protein, 193 aa, Homo sapiens
MLCPDPGRGCRLERERRKPKSSKASGFGVGAGVGWRGRGEVILVLEDGVVRTEVGAEYTARYDAEPVFPADGLGLPEAGGGGARRLRTAYTNTQLLELEKEFHFNKYLCRPRRVEIAALLDLTERQVKVWFQNRRMKHKRQTQHREPPDGEPACPGALEDICDPAEEPAASPGGPSASRAAWEACCHPPEVVP

SEQ ID NO: 798148 - protein, 356 aa, Homo sapiens; identical to SEQ ID NO: 798145

SEQ ID NO: 798149 - protein, 114 aa, Homo sapiens
MIFQPRPPKVLGLQSATAPEMFSTVTHKGPDRAIIPEMEWTSQALLTVDIVDSGNLVEITVFGRPRVQNRVKSMLLCLAWFHREHRARAEKMKHLEKNLKAHASDPHSPQDPVA

SEQ ID NO: 798150 - protein, 371 aa, Homo sapiens
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTVRMTLVIVVVYVLCWAPFFLVQLWAAWDPEAPLEGAPFVLLMLLASLNSCTNPWIYASFSSSVSSELRSLLCCARGRTPPSLGPQDESCTTASSSLAKDTSS

SEQ ID NO: 798151 - protein, 470 aa, Homo sapiens
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTVRMTLVIVVVYVLCWAPFFLVQLWAAWDPEAPLEGGCSRGYGLTGPLGLGRMPLCPTSHPEPNLDPPPPQGRPLCYSCCWPASTAAPTPGSMHLSAAACPQSCEACSAVPGDAPHPAWVPKMSPAPPPAPPWPRTLHREELLGVLPLEALRSSAAFLGLVLGATGRGTRGELARACGPEAGTLCGPGQATAPAWVSTSPAV

SEQ ID NO: 798152 - protein, 259 aa, Homo sapiens
MVFVAPTLGIAACQVLIFREIHASLVPGPSERPGGRRRGRRTGSPGEGAHVSAAVAKTVRMTLVIVVVYVLCWAPFFLVQLWAAWDPEAPLEGGCSRGYGLTGPLGLGRMPLCPTSHPEPNLDPPPPQGRPLCYSCCWPASTAAPTPGSMHLSAAACPQSCEACSAVPGDAPHPAWVPKMSPAPPPAPPWPRTLHREELLGVLPLEALRSSAAFLGLVLGATGRGTRGELARACGPEAGTLCGPGQATAPAWVSTSPAV

SEQ ID NO: 798153 - protein, 371 aa, Homo sapiens; identical to SEQ ID NO: 798150

SEQ ID NO: 798154 - protein, 500 aa, Homo sapiens
SWRPRQGGRRAEAGRAYSMEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 798155 - protein, 442 aa, Homo sapiens
SWRPRQGGRRAEAGRAYSMEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGNYTYLDIAG

SEQ ID NO: 798156 - protein, 218 aa, Homo sapiens
SWRPRQGGRRAEAGRAYSMEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLGK

SEQ ID NO: 798157 - protein, 456 aa, Homo sapiens
MGITLIWCLALVLIKWITSKRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 798158 - protein, 456 aa, Homo sapiens; identical to SEQ ID NO: 798157

SEQ ID NO: 798159 - protein, 336 aa, Homo sapiens
MLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 798160 - protein, 173 aa, Homo sapiens
METQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 798161 - protein, 456 aa, Homo sapiens; identical to SEQ ID NO: 798157

SEQ ID NO: 798162 - protein, 442 aa, Homo sapiens; identical to SEQ ID NO: 798155

SEQ ID NO: 798163 - protein, 186 aa, Homo sapiens
SWRPRQGGRRAEAGRAYSMEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGK

SEQ ID NO: 798164 - protein, 336 aa, Homo sapiens; identical to SEQ ID NO: 798159

SEQ ID NO: 798165 - protein, 360 aa, Homo sapiens
MLEKVGNWNFDIFLFDRLTNGNSLVSLTFHLFSLHGLIEYFHLDMMKLRRFLVMIQEDYHSQNPYHNAVHAADVTQAMHCYLKEPKAELMWIIKHFVQVEPKVSLIDVTLLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 798166 - protein, 456 aa, Homo sapiens; identical to SEQ ID NO: 798157

SEQ ID NO: 798167 - protein, 410 aa, Homo sapiens
SWRPRQGGRRAEAGRAYSMEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGKLQY

SEQ ID NO: 798168 - protein, 132 aa, Homo sapiens
SWRPRQGGRRAEAGRAYSMEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRMLAL

SEQ ID NO: 798169 - protein, 125 aa, Homo sapiens
MGFGSNQQRRKPAVRLRSVVGVHKASESAAAPAFASSSSEVNPAPKFHWETLRHRCFYRKKTSEAHGNKAMTALEGDQTSSIIPSATQDSTAEPQRTQLKEVFTRALTTEKWEVPSCCHTQPMAG

SEQ ID NO: 798170 - protein, 72 aa, Homo sapiens
CPCVRGTERPLVPAEGSAKTVPSLGARAGGSCRGGAAPPSSELQDFEMTLSSAWRMRYSDCLVLCQLGLPLG

SEQ ID NO: 798171 - protein, 76 aa, Homo sapiens
GPEHPRIEEGARARPSHAPSRDPAARQTDRRTARELKYPDTRTSAEQRAGHAPARSACASALRAGARVTCAEPAVM

SEQ ID NO: 798172 - protein, 82 aa, Homo sapiens
GPEHPRIEEGARARPSHAPSRDPAARQTDRRTARELKYPDTRTSAEQRAGHAPARSACASALRAGARVTCAVPLVWWKQGAM

SEQ ID NO: 798173 - protein, 82 aa, Homo sapiens; identical to SEQ ID NO: 798172

SEQ ID NO: 798174 - protein, 76 aa, Homo sapiens; identical to SEQ ID NO: 798171

SEQ ID NO: 798175 - protein, 76 aa, Homo sapiens; identical to SEQ ID NO: 798171

SEQ ID NO: 798176 - protein, 460 aa, Homo sapiens; identical to SEQ ID NO: 746776

SEQ ID NO: 798177 - protein, 176 aa, Homo sapiens [sequence omitted]

SEQ ID NO: 798178 - protein, 1148 aa, Homo sapiens
AAAGRAPRRALPPGCHPCPAMSRRKPASGGLAASSSAPARQAVLSRFFQSTGSLKSTSSSTGAADQVDPGAAAAAAPPAPAFPPQLPPHVATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGRSTFMEELTDTAEIIRKATSQSLVILDELGRGTSTHDGIAIAYATLEYFIRDVKSLTLFVTHYPPVCELEKNYSHQVGNYHMGFLVSEDESKLDPGTAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 798179 - protein, 1129 aa, Homo sapiens
AAAGRAPRRALPPGCHPCPAMSRRKPASGGLAASSSAPARQAVLSRFFQSTGSLKSTSSSTGAADQVDPGAAAAAAPPAPAFPPQLPPHVATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKGRMKFKVLLTEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGRSTFMEELTDTAEIIRKATSQSLVILDELGRGTSTHDGIAIAYATLEYFIRDVKSLTLFVTHYPPVCELEKNYSHQVGNYHMGFLVSEDESKLDPGTAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 798180 - protein, 770 aa, Homo sapiens
VTEFYAKDTVDIKGSQIISGIVNLEKPVICSLAAIIKYLKEFNLDRCSPNLTILNSYQVKLEFMTVNGTTLRNLEILQISVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGRSTFMEELTDTAEIIRKATSQSLVILDELGRGTSTHDGIAIAYATLEYFIRDVKSLTLFVTHYPPVCELEKNYSHQVGNYHMGFLVSEDESKLDPGTAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 798181 - protein, 270 aa, Homo sapiens
YTARYEAWVLRPKYTDLSEDSERVMIITGPNMGGKSSYIKQVALITIMAQIGSYVPAEEATIGIVDGIFTRMGAADNIYKGRSTFMEELTDTAEIIRKATSQSLVILDELGRGTSTHDGIAIAYATLEYFIRDVKSLTLFVTHYPPVCELEKNYSHQVGNYHMGFLVSEDESKLDPGTAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 798182 - protein, 1148 aa, Homo sapiens; identical to SEQ ID NO: 798178

SEQ ID NO: 798183 - protein, 1159 aa, Homo sapiens
AAAGRAPRRALPPGCHPCPAMSRRKPASGGLAASSSAPARQAVLSRFFQSTGSLKSTSSSTGAADQVDPGAAAAAAPQRPQRPQAPSAPAPAFPPQLPPHVATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGRSTFMEELTDTAEIIRKATSQSLVILDELGRGTSTHDGIAIAYATLEYFIRDVKSLTLFVTHYPPVCELEKNYSHQVGNYHMGFLVSEDESKLDPGTAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 798184 - protein, 680 aa, Homo sapiens
MDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGRSTFMEELTDTAEIIRKATSQSLVILDELGRGTSTHDGIAIAYATLEYFIRDVKSLTLFVTHYPPVCELEKNYSHQVGNYHMGFLVSEDESKLDPGTAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 798185 - protein, 226 aa, Homo sapiens
HIRGPRYSGHHSAFGCPYSDMNLKKEATLHDRLREQTQANLESDSSHSKSKSLCSLNFNGKHEKVNSQPRLVQQAKCLKIKGKEDIDLDNLFREYSVEQAQQVLHQSVSMSTVSAHPFRDLPLGREQHCKLLPGVADIRASQVARWTVDEVAEFVQSLLGCEEHAKCFKKEQIDGKAFLLLTQTDIVKVMKIKLGPALKIYNSILMFRHSQELPEEDIASGQEVRG

SEQ ID NO: 798186 - protein, 100 aa, Homo sapiens
QKLSSNMRLVRGCSKKVILVIAESKDILVLSAWILTIINDVRQVPSCLNYTDGVCSHDVYLISEESTHNLEIMLYLPPPVKGIPFYTVKSKNASCPQLLS

SEQ ID NO: 798187 - protein, 267 aa, Homo sapiens
MAPAADREGYWGPTTSTLDWCEENYSVTWYIAEFWNTVSNLIMIIPPMFGAIQSVRDGLEKRYIASYLALTVVGMGSWCFHMTLKYEMQLLDELPMIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 798188 - protein, 105 aa, Homo sapiens
MGSWCFHMTLKYEMQLLDELPMIYSCCIFVYCMFECFKIKNSVNYHLLFTLVLFSLIVTTVYLKVKEPIFHQESHSVTPAEVQWHNLGSLEPPPPRSCMECWSLH

SEQ ID NO: 798189 - protein, 225 aa, Homo sapiens
MIIPPMFGAIQSVRDGLEKRYIASYLALTVVGMGSWCFHMTLKYEMQLLDELPMIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 798190 - protein, 213 aa, Homo sapiens
MTLTHIKRYIASYLALTVVGMGSWCFHMTLKYEMQLLDELPMIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 798191 - protein, 267 aa, Homo sapiens; identical to SEQ ID NO: 798187

SEQ ID NO: 798192 - protein, 134 aa, Homo sapiens
MAQSRLIGTSTSQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 798193 - protein, 172 aa, Homo sapiens
MIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 798194 - protein, 150 aa, Homo sapiens
TPLCFSLSLFPSLSLFLSLPFSFFLSCSLCLLLALSLFLFLAPLRKAKFVESPRIPESELGSPTLTSAQKLDVDAYCPGDAEQELGPPPSVDEAANTLMTRLGFLLGEKVTEVQPGDQYSMEVQDENQTSAITQRISPCSTLTSSTASPP

SEQ ID NO: 798195 - protein, 147 aa, Homo sapiens
MGATPTPFAPRPRAERRPRQCPQGTETEAGVSVPPRKEEGGPYVAGLTAPRRVLRAMAPALWRACNGLMAAFFALAALVQVNDPDAEVWVVVYTIPAVLTLLVGLNPEVTGECYLEKYLCNTHTLLYGVGCWLGVLPLASYTTEHLT

SEQ ID NO: 798196 - protein, 160 aa, Homo sapiens
MAPALWRACNGLMAAFFALAALVQVNDPDAEVWVVVYTIPAVLTLLVGLNPEVTGNVIWKSISAIHILFCTVWAVGLASYLLHRTQQNILHEEEGRELSGLVIITAWIILCHSSSKNPVGGRIQLAIAIVITLFPFISWVYIYINKEMRSSWPTHCKTVI

SEQ ID NO: 798197 - protein, 140 aa, Homo sapiens
MAPALWRACNGLMAAFFALAALVQVNDPDAEVWVVVYTIPAVLTLLVGLNPEVTGNVIWKSISAIHILFCTVWAVGLASYLLHRTQQNILHEEEGRELSGLVIITAWIILCHSSSKGRVLLCCPDWKAVARSQLTAASNS

SEQ ID NO: 798198 - protein, 176 aa, Homo sapiens
MAPALWRACNGLMAAFFALAALVQVNDPDAEVWVVVYTIPAVLTLLVGLNPEVTGNVIWKSISAIHILFCTVWAVGLASYLLHRTQQNILHEEEGRFKLFFCLSLLSSWDYRELSGLVIITAWIILCHSSSKNPVGGRIQLAIAIVITLFPFISWVYIYINKEMRSSWPTHCKTVI

SEQ ID NO: 798199 - protein, 457 aa, Homo sapiens
MSQGSVTFRDVAIDFSQEEWKWLQPAQRDLYRCVMLENYGHLVSLGLSISKPDVVSLLEQGKEPWLGKREVKRDLFSVSESSGEIKDFSPKNVIYDDSSQYLIMERILSQGPVYSSFKGGWKCKDHTEMLQENQGCIRKVTVSHQEALAQHMNISTVERPYGCHECGKTFGRRFSLVLHQRTHTGEKPYACKECGKTFSQISNLVKHQMIHTGKKPHECKDCNKTFSYLSFLIEHQRTHTGEKPYECTECGKAFSRASNLTRHQRIHIGKKQYICRKCGKAFSSGSELIRHQITHTGEKPYECIECGKAFRRFSHLTRHQSIHTTKTPYECNECRKAFRCHSFLIKHQRIHAGEKLYECDECGKVFTWHASLIQHTKSHTGEKPYACAECDKAFSRSFSLILHQRTHTGEKPYVCKVCNKSFSWSSNLAKHQRTHTLDNPYEYENSFNYHSFLTEHQ

SEQ ID NO: 798200 - protein, 510 aa, Homo sapiens
MSQGSVTFRDVAIDFSQEEWKWLQPAQRDLYRCVMLENYGHLVSLGLSISKPDVVSLLEQGKEPWLGKREVKRDLFSGFFSANCVSFFSWAHVDGSAFLVDGNFFCTVVTEVVKNYRGEDYCNSQPCSFIVSESSGEIKDFSPKNVIYDDSSQYLIMERILSQGPVYSSFKGGWKCKDHTEMLQENQGCIRKVTVSHQEALAQHMNISTVERPYGCHECGKTFGRRFSLVLHQRTHTGEKPYACKECGKTFSQISNLVKHQMIHTGKKPHECKDCNKTFSYLSFLIEHQRTHTGEKPYECTECGKAFSRASNLTRHQRIHIGKKQYICRKCGKAFSSGSELIRHQITHTGEKPYECIECGKAFRRFSHLTRHQSIHTTKTPYECNECRKAFRCHSFLIKHQRIHAGEKLYECDECGKVFTWHASLIQHTKSHTGEKPYACAECDKAFSRSFSLILHQRTHTGEKPYVCKVCNKSFSWSSNLAKHQRTHTLDNPYEYENSFNYHSFLTEHQ

SEQ ID NO: 798201 - protein, 467 aa, Homo sapiens [sequence omitted]

SEQ ID NO: 798202 - protein, 410 aa, Homo sapiens
LHSVAKEGRNGLILFNTGKRNIHFFFWYLSVSESSGEIKDFSPKNVIYDDSSQYLIMERILSQGPVYSSFKGGWKCKDHTEMLQENQGCIRKVTVSHQEALAQHMNISTVERPYGCHECGKTFGRRFSLVLHQRTHTGEKPYACKECGKTFSQISNLVKHQMIHTGKKPHECKDCNKTFSYLSFLIEHQRTHTGEKPYECTECGKAFSRASNLTRHQRIHIGKKQYICRKCGKAFSSGSELIRHQITHTGEKPYECIECGKAFRRFSHLTRHQSIHTTKTPYECNECRKAFRCHSFLIKHQRIHAGEKLYECDECGKVFTWHASLIQHTKSHTGEKPYACAECDKAFSRSFSLILHQRTHTGEKPYVCKVCNKSFSWSSNLAKHQRTHTLDNPYEYENSFNYHSFLTEHQ

SEQ ID NO: 798203 - protein, 394 aa, Homo sapiens
MSQGSVTFRDVAIDFSQEEWKWLQPAQRDLYRCVMLENYGHLVSLGLSISKPDVVSLLEQGKEPWLGKREVKRDLFSVSESSGEIKDFSPKNVIYDDSSQYLIMERILSQGPVYSSFKGGWKCKDHTEMLQENQGCIRKVTVSHQEALAQHMNISTVERPYGCHECGKTFGRRFSLVLHQRTHTGEKPYACKECGKTFSQISNLVKHQMIHTGKKPHECKDCNKTFSYLSFLIEHQRTHTGEKPYECTECGKAFSRASNLTRHQRIHIGKKQYICRKCGKAFSSGSELIRHQITHTGEKPYECIECGKAFRRFSHLTRHQSIHTTKTPYECNECRKAFRCHSFLIKHQRIHAGEKLYECDECGKVFTWHASLIQHTKKLHCGKTTIVISVAKSP

SEQ ID NO: 798204 - protein, 457 aa, Homo sapiens; identical to SEQ ID NO: 798199

SEQ ID NO: 798205 - protein, 457 aa, Homo sapiens; identical to SEQ ID NO: 798199

SEQ ID NO: 798206 - protein, 354 aa, Homo sapiens
MERILSQGPVYSSFKGGWKCKDHTEMLQENQGCIRKVTVSHQEALAQHMNISTVERPYGCHECGKTFGRRFSLVLHQRTHTGEKPYACKECGKTFSQISNLVKHQMIHTGKKPHECKDCNKTFSYLSFLIEHQRTHTGEKPYECTECGKAFSRASNLTRHQRIHIGKKQYICRKCGKAFSSGSELIRHQITHTGEKPYECIECGKAFRRFSHLTRHQSIHTTKTPYECNECRKAFRCHSFLIKHQRIHAGEKLYECDECGKVFTWHASLIQHTKSHTGEKPYACAECDKAFSRSFSLILHQRTHTGEKPYVCKVCNKSFSWSSNLAKHQRTHTLDNPYEYENSFNYHSFLTEHQ

SEQ ID NO: 798207 - protein, 457 aa, Homo sapiens; identical to SEQ ID NO: 798199

SEQ ID NO: 798208 - protein, 84 aa, Homo sapiens
RNAIQESAITGNSYDLEIIDDQVIWYHTDTAIHARKKYPRSMWNSHEEPSIIIRQYQGGNLMNVLSVERPLAVPPTSLDIKEFT

SEQ ID NO: 798209 - protein, 165 aa, Homo sapiens
PPHFPKPAGAPPNTSAAPPTHSPRPPPGEKMKPDWPRRGAAGTRVRSRGEGDGTYFARRGAGRRRREIKAPIRAAWSPPSAAMSGLQSGRRWRPQGTGTGARAAGALAALRLGPRLRAAPLLAPLWLLAPTPDSHMTPAPLALRASRGWRENNLSDYQYSWMQKC

SEQ ID NO: 798210 - protein, 556 aa, Homo sapiens [sequence omitted]

SEQ ID NO: 798211 - protein, 582 aa, Homo sapiens
MSDLHVLLLMALVGKTACGFSADVFIRESAGAQSWIPWTSSDYSVRRISTISVEQTQRDGSRTNCSRSVQYFAGAGYHSTCDVTQKHGVACTDRIARLVNEQVGRHGRLSYVESASRLQRGLASVSLGISVRMQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 798212 - protein, 556 aa, Homo sapiens [sequence omitted]

SEQ ID NO: 798213 - protein, 260 aa, Homo sapiens
GWRPRPAPPGCSMALCEAAGCGSALLWPRLLLFGDSITQFSFQQGGWGASLADRLVRKCDVLNRGFSGYNTRWAKIILPRLIRKGNSLDIPVAVTIFFGANDSALKDENPKQHIPLEEYAANLKSMVQYLKSVDIPENRVILITPTPLCETAWEEQCIIQGCKLNRLNSVVGEYANACLQVAQDCGTDVLDLWTLMQDSQDFSSYLSDGLHLSPKGNEFLFSHLWPLIEKKVSSLPLLLPYWRDVAEAKPELSLLGDGDH

SEQ ID NO: 798214 - protein, 242 aa, Homo sapiens
AGGPAPPRPAAPWRCARPRAAGVPCSGLACCSSGTPSPRKCDVLNRGFSGYNTRWAKIILPRLIRKGNSLDIPVAVTIFFGANDSALKDENPKQHIPLEEYAANLKSMVQYLKSVDIPENRVILITPTPLCETAWEEQCIIQGCKLNRLNSVVGEYANACLQVAQDCGTDVLDLWTLMQDSQDFSSYLSDGLHLSPKGNEFLFSHLWPLIEKKVSSLPLLLPYWRDVAEAKPELSLLGDGDH

SEQ ID NO: 798215 - protein, 284 aa, Homo sapiens
NEGPRLDLSCKAPPGDPSELGTSNLKKVMLYAHRPAPGSGVGLCAGAPGPSVTHLQLRDFKASFPPVRFYARLPNFIAQLRKCDVLNRGFSGYNTRWAKIILPRLIRKGNSLDIPVAVTIFFGANDSALKDENPKQHIPLEEYAANLKSMVQYLKSVDIPENRVILITPTPLCETAWEEQCIIQGCKLNRLNSVVGEYANACLQVAQDCGTDVLDLWTLMQDSQDFSSYLSDGLHLSPKGNEFLFSHLWPLIEKKVSSLPLLLPYWRDVAEAKPELSLLGDGDH

SEQ ID NO: 798216 - protein, 260 aa, Homo sapiens; identical to SEQ ID NO: 798213

SEQ ID NO: 798217 - protein, 119 aa, Homo sapiens
ESPGSRHRREGTRPRCPPRAASHPGRDARSSPQRPPGQRPFPSGSGLAAAGDRALCPRRPRGQLRAEAPGALSPHSLRAQVGPLGVDLGSKTPSGISFPSSRVDGEHRWLTGWSENVMF

SEQ ID NO: 798218 - protein, 223 aa, Homo sapiens
MQFSFQQGGWGASLADRLVRKCDVLNRGFSGYNTRWAKIILPRLIRKGNSLDIPVAVTIFFGANDSALKDENPKQHIPLEEYAANLKSMVQYLKSVDIPENRVILITPTPLCETAWEEQCIIQGCKLNRLNSVVGEYANACLQVAQDCGTDVLDLWTLMQDSQDFSSYLSDGLHLSPKGNEFLFSHLWPLIEKKVSSLPLLLPYWRDVAEAKPELSLLGDGDH

SEQ ID NO: 798219 - protein, 135 aa, Homo sapiens
MVQYLKSVDIPENRVILITPTPLCETAWEEQCIIQGCKLNRLNSVVGEYANACLQVAQDCGTDVLDLWTLMQDSQDFSSYLSDGLHLSPKGNEFLFSHLWPLIEKKVSSLPLLLPYWRDVAEAKPELSLLGDGDH

SEQ ID NO: 798220 - protein, 231 aa, Homo sapiens
LAAPPRPARLLHGAVRGRGLRECPALASLVALRGLHHPGYNTRWAKIILPRLIRKGNSLDIPVAVTIFFGANDSALKDENPKQHIPLEEYAANLKSMVQYLKSVDIPENRVILITPTPLCETAWEEQCIIQGCKLNRLNSVVGEYANACLQVAQDCGTDVLDLWTLMQDSQDFSSYLSDGLHLSPKGNEFLFSHLWPLIEKKVSSLPLLLPYWRDVAEAKPELSLLGDGDH

SEQ ID NO: 798221 - protein, 210 aa, Homo sapiens
GWRPRPAPPGCSMALCEAAGCGSALLWPRLLLFGDSITQFSFQQGGWGASLADRLVRKCDVLNRGFSGYNTRWAKIILPRLIRKGNSLDIPVAVTIFFGANDSALKDENPKQHIPLEEYAANLKSMVQYLKSVDIPENRVILITPTPLCETAWEEQCIIQGCKLNRLNSVVGEYANACLQVAQDCGTDVLDLWTLMQDSQGTVACSVLSG

SEQ ID NO: 798222 - protein, 172 aa, Homo sapiens
AVSEECLSPAVPELQHSSHCCLLSCSHMDTFTVQDSTAMSWWRNNFWIILAVAIIVVSVGLGLILYCVCKWQLRRGKKWEIAKPLKHKQVDEEKMYENVLNESPVQLPPLPPRNWPSLEDSSPQEAPSQPPATYSLVNKVKNKKTVSIPSYIEPEDDYDDVEIPANTEKASF

SEQ ID NO: 798223 - protein, 172 aa, Homo sapiens; identical to SEQ ID NO: 798222

SEQ ID NO: 798224 - protein, 452 aa, Homo sapiens
RAHTGALSLLSSSSPFSSPSSSSSPSSSSSSSLPSSSPSSFSSSTSSPSSSSSCAHRRQPALCAHPESSSTWVRDREGHIRSRRSMKMLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGKRIHLLTRRNFLLGKWIIFSGQMFGRILCQLGSFIFAENIARCEWNYFMAKRNICMYSYTSILLPSFPLP

SEQ ID NO: 798225 - protein, 431 aa, Homo sapiens
MLVHSFSAMDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 798226 - protein, 476 aa, Homo sapiens
RAHTGALSLLSSSSPFSSPSSSSSPSSSSSSSLPSSSPSSFSSSTSSPSSSSSCAHRRQPALCAHPESSSTWVRDREGHIRSRRSMKMLWKLTDNIKYEDCEDRHDGTSNGTARLPQLGTPEPPARPAAAAAPRLARPEESQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 798227 - protein, 483 aa, Homo sapiens
MAAAGRVSVLLAAQILDFKPLHWRQAGTALQGLALESRPFSGRRAAPSLQPGSAEELCSVQDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 798228 - protein, 145 aa, Homo sapiens
MPGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 798229 - protein, 300 aa, Homo sapiens
MLVHSFSAMDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGAEMAAVLRQEY

SEQ ID NO: 798230 - protein, 524 aa, Homo sapiens
RAHTGALSLLSSSSPFSSPSSSSSPSSSSSSSLPSSSPSSFSSSTSSPSSSSSCAHRRQPALCAHPESSSTWVRDREGHIRSRRSMKMLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 798231 - protein, 433 aa, Homo sapiens
MSILAKMGDWQDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 798232 - protein, 285 aa, Homo sapiens
MRAGVGQDLGVIHDAQHAASPLSPAGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 798233 - protein, 449 aa, Homo sapiens
MLVHSFSAMDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDHGNPIHYTIPFPCEADHPGPPTTPKIRRQPKA

SEQ ID NO: 798234 - protein, 300 aa, Homo sapiens; identical to SEQ ID NO: 798229

SEQ ID NO: 798235 - protein, 258 aa, Homo sapiens
MSGCELSPLGLRVGLSAGPAHGRRFPAPSGPWTGLNLASRQGAGPKPRDSRPYKAAAVGAWHARPEACAHTLSCPALARLGRARRRPWMSHRTSSTFRAERSFHSSSSSSSSSTSSSASRALPAQDPPMEKALSMFSDDFGSFMRPHSEPLAFPARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 798236 - protein, 443 aa, Homo sapiens
MSGCELSPLGLRVGLSAGPAHGRRFPAPSGPWTGLNLASRQGAGPKPRDSRPYKAAAVGAWHARPEACAHTLSCPALARLGRARRRPWMSHRTSSTFRAERSFHSSSSSSSSSTSSSASRALPAQDPPMEKALSMFSDDFGSFMRPHSEPLAFPGKCPGPEGRGGAQGGDVCSRAPPKALWLPVGLEQVLHSLQPCVATKTDVATGTDVAMKTGGPLRNSCGPGGWTWFHGHPCSVTTANPSWSPGGLDGGAVGGSPQAPGLGWGCYRPSLIYTHTVLGEAPPPPQKRWAVGMRRSLGETARGEVGPGGAAPCPKRRSQNPRICMQGLLHASLTAAHPTARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 798237 - protein, 258 aa, Homo sapiens; identical to SEQ ID NO: 798235

SEQ ID NO: 798238 - protein, 131 aa, Homo sapiens
MDRGLVFRPRICMQGLLHASLTAAHPTARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 798239 - protein, 659 aa, Homo sapiens
MSLPPEKASELKQLIHQQLSKMDVHGRIREILAETIREELAPDQQHLSTEDLIKALRRRGIIDDVMKELNFVTDSVEQELPSSPKQPICFDRQSTLKKTNIDPTRRYLYLQVLGGKAFLEHLQEPEPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLGNCQPSDAVETCVFDLNDESKWKPMSEEAIKSVCAPGATTSLPPFPPLCASTIDASVTSNEIEMQLRLLVSEHRKDLGLTTVWEDQLSYLLSPALASYEFERTTSISAGNEEFQDAIRRAVPDGHTFKGFPIHFVYRNARRAFATCLRSPFCEEIICCRGDQVRLAVRVRVFTYPESACAVWIMFACKYRSVL

SEQ ID NO: 798240 - protein, 481 aa, Homo sapiens
MADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLGNCQPSDAVETCVFDLNDESKWKPMSEEAIKSVCAPGATTSLPPFPPLCASTIDASVTSNEIEMQLRLLVSEHRKDLGLTTVWEDQLSYLLSPALASYEFERTTSISAGNEEFQDAIRRAVPDGHTFKGFPIHFVYRNARRAFATCLRSPFCEEIICCRGDQVRLAVRVRVFTYPESACAVWIMFACKYRSVL

SEQ ID NO: 798241 - protein, 657 aa, Homo sapiens
MSLPPEKASELKQLIHQQLSKMDVHGRIREILAETIREELAPDQQHLSTEDLIKALRRRGIIDDVMKELNFVTDSVEQELPSSPKQPICFDRQSTLKKTNIDPTRRYLYLQVLGGKAFLEHLQEPEPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLGNCQPSDAVETCVFDLNDESKWKPMSEEAIKSVCAPGATTSLPPFPPLCASTIDASVTSNEIEMQLRLLVSEHRKDLGLTTVWEDQLSYLLSPALASYEFERTTSISAGNEEFQDAIRRAVPDGHTFKGFPIHFVYRNARRAFATCLRSPFCEEIICCRGDQVRLAVRVRVFTYPESACAVWIMFACECAS

SEQ ID NO: 798242 - protein, 382 aa, Homo sapiens
MSLPPEKASELKQLIHQQLSKMDVHGRIREILAETIREELAPDQQHLSTEDLIKALRRRGIIDDVMKELNFVTDSVEQELPSSPKQPICFDRQSTLKKTNIDPTRRYLYLQVLGGKAFLEHLQEPEPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKLGREMRFS

SEQ ID NO: 798243 - protein, 316 aa, Homo sapiens
MSLPPEKASELKQLIHQQLSKMDVHGRIREILAETIREELAPDQQHLSTEDLIKALRRRGIIDDVMKELNFVTDSVEQELPSSPKQPICFDRQSTLKKTNIDPTRRYLYLQVLGGKAFLEHLQEPEPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQVCKLY

SEQ ID NO: 798244 - protein, 659 aa, Homo sapiens; identical to SEQ ID NO: 798239

SEQ ID NO: 798245 - protein, 616 aa, Homo sapiens
MSLPPEKASELKQLIHQQLSKMDVHGRIREILAETIREELAPDQQHLSTEDLIKALRRRGIIDDVMKELNFVTDSVEQELPSSPKQPICFDRQSTLKKTNIDPTRRYLYLQVLGGKAFLEHLQEPEPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQDENGINRPVCSYVKPLRAGRLLDTPRQAARFVNVLGYERAPVIGGGGKQEQWCTLLAFLCRNKGDCEDHANLLCSLLLGYGLEAFVCVGTKAKGVPHAWVMTCGTDGAITFWESLTGHRYIHKPTNPDEPPVAEQPKPLYPYRTIGCVFNHQMFLGNCQPSDAVETCVFDLNDESKWKPMSEEAIKSVCAPGATTSLPPFPPLCASTIDASVTSNEIEMQLRLLVSEHRKDLGLTTVWEDQLSYLLSPALASYEFERTTSISAGNEEFQDAIRRAVPDGHTFKGFPIHFVYRNARRAFATCLRSPFCEEIICCRGDQVRLAVRVRVFTYPESACAVWIMFACKYRSVL

SEQ ID NO: 798246 - protein, 481 aa, Homo sapiens; identical to SEQ ID NO: 798240

SEQ ID NO: 798247 - protein, 389 aa, Homo sapiens
MSLPPEKASELKQLIHQQLSKMDVHGRIREILAETIREELAPDQQHLSTEDLIKALRRRGIIDDVMKELNFVTDSVEQELPSSPKQPICFDRQSTLKKTNIDPTRRYLYLQVLGGKAFLEHLQEPEPLPGQVCSTFTLCLHYRNQRFRSKPVPCACEPDFHDGFLLEVHRESLGDGTRMADSTTMLSISDPIHMVLIKTDIFGETTLVASYFLEWRSVLGSENGVTSLTVELMGVGTESKVSVGILNIKLEMYPPLNQTLSQEVVNTQLALERQKTAEKERLFLVYAKQWWREYLQIRPSHNSRLVKIFAQDENGINRPVCSYVKPLRAGRLLDTPRQAARFVNVLGYERAPVIGGGGKQEQWCTLLAFLCRNKTRYYTHIIELSSSIS

SEQ ID NO: 798248 - protein, 74 aa, Homo sapiens
MQRGARLPAEVAGQVLWALPPLTWRQQGTCAPGEGRLPADGPSFAFTTHNFPYPLLLKGNNPKYPCWVNNTLLP

SEQ ID NO: 798249 - protein, 448 aa, Homo sapiens
MVLSKSGPGDGFFSSAFQARLSGNNLHNASIPEHLAYGSVITVKNLRMAIGYLHSHRHLYPEGIGARQQQVTTYLHKDYNNLWIIKKHNTNSDPLDPSFPVEFVRHGDIIRLEHKETSRNLHSHYHEAPMTRKHYQVTGYGINGTGDSNDFWRIEVVNRKFGNRIKVLRSRIRFIHLVTGCVLGSSGKVLPKWGWEQLEVTCTPYLKETLNSIWNVEDHINPKLPNISLDVLQPSFPEILLESHMVMIRGNSGLKPKDNEFTSKPWHWPINYQGLRFSGVNDTDFRVYLLGNPVVWWLNLLSIALYLLSGSIIAVAMQRGARLPAEVAGLSQVLLRGGGQVLLGWTLHYFPFFLMGRVLYFHHYFPAMLFSSMLTGILWDTLLRLCAWGLASWPLARGIHVAGILSLLLGTAYSFYLFHPLAYGMVGPLAQDPQSPMAGLRWLDSWDF

SEQ ID NO: 798250 - protein, 750 aa, Homo sapiens
MPPATGGGLAESELRPRRGRCGPQAARAAGRDVAAEAVARSPKRPAWGSRRFEAVGWWALLALVTLLSFATRFHRLDEPPHICWDETHFGKMGSYYINRTFFFDVHPPLGKMLIGLAGYLSGYDGTFLFQKPGDKYEHHSYMGMRGFCAFLGSWLVPFAYLTVLDLSKSLSAALLTAALLTFDTGCLTLSQYILLDPILMFFIMAAMLSMVKYNSCADRPFSAPWWFWLSLTGVSLAGALGVKFVGLFIILQVGLNTIADLWYLFGDLSLSLVTVGKHLTARVLCLIVLPLALYTATFAVHFMVLSKSGPGDGFFSSAFQARLSGNNLHNASIPEHLAYGSVITVKNLRMAIGYLHSHRHLYPEGIGARQQQVTTYLHKDYNNLWIIKKHNTNSDPLDPSFPVEFVRHGDIIRLEHKETSRNLHSHYHEAPMTRKHYQVTGYGINGTGDSNDFWRIEVVNRKFGNRIKVLRSRIRFIHLVTGCVLGSSGKVLPKWGWEQLEVTCTPYLKETLNSIWNVEDHINPKLPNISLDVLQPSFPEILLESHMVMIRGNSGLKPKDNEFTSKPWHWPINYQGLRFSGVNDTDFRVYLLGNPVVWWLNLLSIALYLLSGSIIAVAMQRGARLPAEVAGLSQVLLRGGGQVLLGWTLHYFPFFLMGRVLYFHHYFPAMLFSSMLTGILWDTLLRLCAWGLASWPLARGIHVAGILSLLLGTAYSFYLFHPLAYGMVGPLAQDPQSPMAGLRWLDSWDF

SEQ ID NO: 798251 - protein, 750 aa, Homo sapiens; identical to SEQ ID NO: 798250

SEQ ID NO: 798252 - protein, 319 aa, Homo sapiens [sequence omitted]

SEQ ID NO: 798253 - protein, 842 aa, Homo sapiens
MPPATGGGLAESELRPRRGRCGPQAARAAGRDVAAEAVARSPKRPAWGSRRFEAVGWWALLALVTLLSFATRFHRLDEPPHICWDETHFGKMGSYYINRTFFFDVHPPLGKMLIGLAGYLSGYDGTFLFQKPGDKYEHHSYMGMRGFCAFLGSWLVPFAYLTVLDLSKSLSAALLTAALLTFDTGCLTLSQYILLDPILMFFIMAAMLSMVKYNSCADRPFSAPWWFWLSLTGVSLAGALGVKFVGLFIILQVGLNTIADLWYLFGDLSLSLVTVGKHLTARVLCLIVLPLALYTATFAVHFMVLSKSGPGDGFFSSAFQARLSGNNLHNASIPEHLAYGSVITVKNLRMAIGYLHSHRHLYPEGIGARQQQVTTYLHKDYNNLWIIKKHNTNSDPLDPSFPVEFVRHGDIIRLEHKETSRNLHSHYHEAPMTRKHYQVTGYGINGTGDSNDFWRIEVVNRKFGNRIKVLRSRIRFIHLVTGCVLGSSGKVLPKWGWEQLEVTCTPYLKETLNSIWNVEDHINPKLPNISLDVLQPSFPEILLESHMVMIRGNSGLKPKDNEFTSKPWHWPINYQGLRFSGVNDTDFRVYLLGNPVVWWLNLLSIALYLLSGSIIAVAMQRGARLPAEVAGLSQVLLRGGGQVLLGWTLHYFPFFLMGRVLYFHHYFPAMLFSSMLTGILWDTLLRLCAWGLASWPLARGIHVAGILSLLLGTAYSCLRSPKNSAAHQDPALGVQLEWNPALERAGREPQLRPQHHGEDSASWAAPSCTAQGRMGARGWEWVRVCVCEGMLSISLWNTDRVTGQLSVINSKIVQAIVIFSGIFFCWISLVLVCKIHQKFSDL

SEQ ID NO: 798254 - protein, 179 aa, Homo sapiens
KVTQQGRGRAGPEPGISARSLSSDWAVLLGPRVVPGPAARRRPGPARLDTPLLPVFPDGPGPLLPPLLPSHALLKHVDRHSVGHPPAALCLGLGLMAPGEGHTCGGNPEPAPGNCLQLLPLPPSGLRDGWSPGPGPPKSNGRTKVAGLMGLLRPLQRFQPGSRNFPGEPAGKQYWTIRP

SEQ ID NO: 798255 - protein, 792 aa, Homo sapiens
MPPATGGGLAESELRPRRGRCGPQAARAAGRDVAAEAVARSPKRPAWGSRRFEAVGWWALLALVTLLSFATRFHRLDEPPHICWDETHFGKMGSYYINRTFFFDVHPPLGKMLIGLAGYLSGYDGTFLFQKPGDKYEHHSYMGMRGFCAFLGSWLVPFAYLTVLDLSKSLSAALLTAALLTFDTGCLTLSQYILLDPILMFFIMAAMLSMVKYNSCADRPFSAPWWFWLSLTGVSLAGALGVKFVGLFIILQVGLNTIADLWYLFGDLSLSLVTVGKHLTARVLCLIVLPLALYTATFAVHFMVLSKSGPGDGFFSSAFQARLSGNNLHNASIPEHLAYGSVITVKNLRMAIGYLHSHRHLYPEGIGARQQQVTTYLHKDYNNLWIIKKHNTNSDPLDPSFPVEFVRHGDIIRLEHKETSRNLHSHYHEAPMTRKHYQVTGYGINGTGDSNDFWRIEVVNRKFGNRIKVLRSRIRFIHLVTGCVLGSSGKVLPKWGWEQLEVTCTPYLKETLNSIWNVEDHINPKLPNISLDVLQPSFPEILLESHMVMIRGNSGLKPKDNEFTSKPWHWPINYQGLRFSGVNDTDFRVYLLGNPVVWWLNLLSIALYLLSGSIIAVAMQRGARLPAEVAGLSQVLLRGGGQVLLGWTLHYFPFFLMGRVLYFHHYFPAMLFSSMLTGILWDTLLRLCAWGLASWPLARGIHVAGILSLLLGTAYSKDSTLHPLVKDGWAPGQDPSHGRLAVARTWSTCRISGQELREQGHMARRESRANGPTWRRCTRRKDKERRSTREGP

SEQ ID NO: 798256 - protein, 693 aa, Homo sapiens
MPPATGGGLAESELRPRRGRCGPQAARAAGRDVAAEAVARSPKRPAWGSRRFEAVGWWALLALVTLLSFATRFHRLDEPPHICWDETHFGKMGSYYINRTFFFDVHPPLGKMLIGLAGYLSGYDGTFLFQKPGDKYEHHSYMGMRGFCAFLGSWLVPFAYLTVLDLSKSLSAALLTAALLTFDTGCLTLSQYILLDPILMFFIMAAMLSMVKYNSCADRPFSAPWWFWLSLTGVSLAGALGVKFVGLFIILQVGLNTIADLWYLFGDLSLSLVTVGKHLTARVLCLIVLPLALYTATFAVHFMVLSKSGPGDGFFSSAFQARLSGNNLHNASIPEHLAYGSVITVKNLRMAIGYLHSHRHLYPEGIGARQQQVTTYLHKDYNNLWIIKKHNTNSDPLDPSFPVEFVRHGDIIRLEHKETSRNLHSHYHEAPMTRKHYQVTGYGINGTGDSNDFWRIEVVNRKFGNRIKVLRSRIRFIHLVTGCVLGSSGKVLPKWGWEQLEVTCTPYLKETLNSIWNVEDHINPKLPNISLDVLQPSFPEILLESHMVMIRGNSGLKPKDNEFTSKPWHWPINYQGLRFSGVNDTDFRVYLLGNPVVWWLNLLSIALYLLSGSIIAVAMQRGARLPAEVAGQVLWALPPLTWRQQGTCAPGEGRLPADGPSFAFTTHNFPYPLLLKGNNPQVPVLRCTTLYFL

SEQ ID NO: 798257 - protein, 593 aa, Homo sapiens
MPPATGGGLAESELRPRRGRCGPQAARAAGRDVAAEAVARSPKRPAWGSRRFEAVGWWALLALVTLLSFATRFHRLDEPPHICWDETHFGKMGSYYINRTFFFDVHPPLGKMLIGLAGYLSGYDGTFLFQKPGDKYEHHSYMGMRGFCAFLGSWLVPFAYLTVLDLSKSLSAALLTAALLTFDTGCLTLSQYILLDPILMFFIMAAMLSMVKYNSCADRPFSAPWWFWLSLTGVSLAGALGVKFVGLFIILQVGLNTIADLWYLFGDLSLSLVTVGKHLTARVLCLIVLPLALYTATFAVHFMVLSKSGPGDGFFSSAFQARLSGNNLHNASIPEHLAYGSVITVKNLRMAIGYLHSHRHLYPEGIGARQQQVTTYLHKDYNNLWIIKKHNTNSDPLDPSFPVEFVRHGDIIRLEHKETSRNLHSHYHEAPMTRKHYQVTGYGINGTGDSNDFWRIEVVNRKFGNRIKVLRSRIRFIHLVTGCVLGSSGKVLPKWGWEQLEVTCTPYLKETLNSIWNVEDHINPKLPNISLDVLQPSFPEILLESHMVMIRGNSGLKPKDNEFTSKPWHWPINYQVGSKAGAPPRKWSQEQEQ

SEQ ID NO: 798258 - protein, 750 aa, Homo sapiens; identical to SEQ ID NO: 798250

SEQ ID NO: 798259 - protein, 448 aa, Homo sapiens; identical to SEQ ID NO: 798249

SEQ ID NO: 798260 - protein, 533 aa, Homo sapiens
DICGSGRIMSPCLTNSTGKEGSRGSEFVGLFIILQVGLNTIADLWYLFGDLSLSLVTVGKHLTARVLCLIVLPLALYTATFAVHFMVLSKSGPGDGFFSSAFQARLSGNNLHNASIPEHLAYGSVITVKNLRMAIGYLHSHRHLYPEGIGARQQQVTTYLHKDYNNLWIIKKHNTNSDPLDPSFPVEFVRHGDIIRLEHKETSRNLHSHYHEAPMTRKHYQVTGYGINGTGDSNDFWRIEVVNRKFGNRIKVLRSRIRFIHLVTGCVLGSSGKVLPKWGWEQLEVTCTPYLKETLNSIWNVEDHINPKLPNISLDVLQPSFPEILLESHMVMIRGNSGLKPKDNEFTSKPWHWPINYQGLRFSGVNDTDFRVYLLGNPVVWWLNLLSIALYLLSGSIIAVAMQRGARLPAEVAGLSQVLLRGGGQVLLGWTLHYFPFFLMGRVLYFHHYFPAMLFSSMLTGILWDTLLRLCAWGLASWPLARGIHVAGILSLLLGTAYSFYLFHPLAYGMVGPLAQDPQSPMAGLRWLDSWDF

SEQ ID NO: 798261 - protein, 243 aa, Homo sapiens
RLRKECMTKAFLLHFFPLVPNISLDVLQPSFPEILLESHMVMIRGNSGLKPKDNEFTSKPWHWPINYQGLRFSGVNDTDFRVYLLGNPVVWWLNLLSIALYLLSGSIIAVAMQRGARLPAEVAGLSQVLLRGGGQVLLGWTLHYFPFFLMGRVLYFHHYFPAMLFSSMLTGILWDTLLRLCAWGLASWPLARGIHVAGILSLLLGTAYSFYLFHPLAYGMVGPLAQDPQSPMAGLRWLDSWDF

SEQ ID NO: 798262 - protein, 149 aa, Homo sapiens
RALAIMTPILWIRKPRNHEIKKLAPGHTARLSQVLLRGGGQVLLGWTLHYFPFFLMGRVLYFHHYFPAMLFSSMLTGILWDTLLRLCAWGLASWPLARGIHVAGILSLLLGTAYSFYLFHPLAYGMVGPLAQDPQSPMAGLRWLDSWDF

SEQ ID NO: 798263 - protein, 750 aa, Homo sapiens; identical to SEQ ID NO: 798250

SEQ ID NO: 798264 - protein, 706 aa, Homo sapiens
MPPATGGGLAESELRPRRGRCGPQAARAAGRDVAAEAVARSPKRPAWGSRRFEAVGWWALLALVTLLSFATRFHRLDEPPHICWDETHFGKMGSYYINRTFFFDVHPPLGKMLIGLAGYLSGYDGTFLFQKPGDKYEHHSYMGMRGFCAFLGSWLVPFAYLTVLDLSKSLSAALLTAALLTFDTGCLTLSQYILLDPILMFFIMAAMLSMVKYNSCADRPFSAPWWFWLSLTGVSLAGALGVKFVGLFIILQVGLNTIADLWYLFGDLSLSLVTVGKHLTARVLCLIVLPLALYTATFAVHFMVLSKSGPGDGFFSSAFQARLSGNNLHNASIPEHLAYGSVITVKNLRMAIGYLHSHRHLYPEGIGARQQQVTTYLHKDYNNLWIIKKHNTNSDPLDPSFPVEFVRHGDIIRLEHKECPLKKIWRWEQKETSRNLHSHYHEAPMTRKHYQVTGYGINGTGDSNDFWRIEVVNRKFGNRIKVLRSRIRFIHLVTGCVLGSSGKVLPKWGWEQLEVTCTPYLKETLNSIWNVEDHINPKLPNISLDVLQPSFPEILLESHMVMIRGNSGLKPKDNEFTSKPWHWPINYQGLRFSGVNDTDFRVYLLGNPVVWWLNLLSIALYLLSGSIIAVAMQRGARLPAEVAGQVLWALPPLTWRQQGTCAPGEGRLPADGPSFAFTTHNFPYPLLLKGNNPQVPVLRCTTLYFL

SEQ ID NO: 798265 - protein, 70 aa, Homo sapiens
LMTTLLPPCSHLAPQFSDGAFLGVTTLKHVHLENNRLNQLPSNFPFDSLETLALTNNPWKCTCQLRGLRR

SEQ ID NO: 798266 - protein, 408 aa, Homo sapiens
DAPRRSWLGCRLRSGPPYKEGGRPERLGLAAARAPPPLLPPAPAPGVPAMVRPMLLLSLGLLAGLLPALAACPQNCHCHSDLQHVICDKVGLQKIPKVSEKTKLLNLQRNNFPVLAANSFRAMPNLVSLHLQHCQIREVAAGAFRGLKQLIYLYLSHNDIRVLRAGAFDDLTELTYLYLDHNKVTELPRGLLSPLVNLFILQLNNNKIRELRAGAFQGAKDLRWLYLSENALSSLQPGALDDVENLAKFHVDRNQLSSYPSAALSKLRVVEELKLSHNPLKSIPDNAFQSFGRYLETLWLDNTNLEKFSDGAFLGVTTLKHVHLENNRLNQLPSNFPFDSLETLALTNNPWKCTCQLRGLRRWLEAKASRPDATCASPAKFKGQHIRDTDAFRSCKFPTKRSKKAGRH

SEQ ID NO: 798267 - protein, 204 aa, Homo sapiens
MRKAPRSPRRSRPAEDAVARVGLELRQSEPAEPPPPPPSSSASSLLLLPPPRPPHSDITCSQSPALYRRRRLGPEGPARPVAPQSRSSPHPLTRTLHVSRAAAAGSAPPHSPEHAAPPTAHGVRAGTDTAQIPAPNGPRPAPYVNARKPSPPAAQSWPHRSRPRSRSLRRRRRGAWRSCSLGIRPAGNTWNLDTAVVCSRRAGF

SEQ ID NO: 798268 - protein, 1331 aa, Homo sapiens
MRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 798269 - protein, 178 aa, Homo sapiens
MRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVV

SEQ ID NO: 798270 - protein, 1331 aa, Homo sapiens; identical to SEQ ID NO: 798268

SEQ ID NO: 798271 - protein, 1331 aa, Homo sapiens; identical to SEQ ID NO: 798268

SEQ ID NO: 798272 - protein, 1331 aa, Homo sapiens; identical to SEQ ID NO: 798268

SEQ ID NO: 798273 - protein, 1331 aa, Homo sapiens; identical to SEQ ID NO: 798268

SEQ ID NO: 798274 - protein, 1331 aa, Homo sapiens; identical to SEQ ID NO: 798268

SEQ ID NO: 798275 - protein, 1331 aa, Homo sapiens; identical to SEQ ID NO: 798268

SEQ ID NO: 798276 - protein, 843 aa, Homo sapiens
MRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVSRRRGSGGGAPR

SEQ ID NO: 798277 - protein, 344 aa, Homo sapiens
MRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCGEQVPPATHLPGTLPLHQPRAQTRASPQTHRFLPLYCNLQKTTTLSPALAFRETLSLCINHHLRSAAQHKKAFLCCLSLQVCNSSPTKRITFTIPATLPVRRGQCYPPSCLY

SEQ ID NO: 798278 - protein, 1301 aa, Homo sapiens
MRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 798279 - protein, 1331 aa, Homo sapiens; identical to SEQ ID NO: 798268

SEQ ID NO: 798280 - protein, 1331 aa, Homo sapiens; identical to SEQ ID NO: 798268

SEQ ID NO: 798281 - protein, 1331 aa, Homo sapiens; identical to SEQ ID NO: 798268

SEQ ID NO: 798282 - protein, 1331 aa, Homo sapiens; identical to SEQ ID NO: 798268

SEQ ID NO: 798283 - protein, 1331 aa, Homo sapiens; identical to SEQ ID NO: 798268

SEQ ID NO: 798284 - protein, 498 aa, Homo sapiens
MRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVMPATAGARPPASGTEPI

SEQ ID NO: 798285 - protein, 1004 aa, Homo sapiens
MKVGWPGESCWQVGLAVEDSPALGAPRVGALPDVVPEGTLLNMVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVGTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRNTPAMLPLHTVPPFISQSLLPSPVSYPCPLATCGWRGIEGPGCALLSQSPPCPKVGQGWLMEKNDVIDIDVCPGVGVGSSGTSAKDWPFLLRYTVMSGTPEKILELLLEAMGPDSSAHDPTGGWPCLDVVVPLTVPTFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKVPYDICRPDHSVLTLQLPVTASVREVMAALAQEDGWTKGQVLVKVNSAGDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 798286 - protein, 524 aa, Homo sapiens
MSGTPEKILELLLEAMGPDSSAHDPTGGWPCLDVVVPLTVPTFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKVPYDICRPDHSVLTLQLPVTASVREVMAALAQEDGWTKGQVLVKVNSAGDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 798287 - protein, 452 aa, Homo sapiens
MSARYEAGVNRPRVSLWCHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 798288 - protein, 166 aa, Homo sapiens [sequence omitted]

SEQ ID NO: 798289 - protein, 923 aa, Homo sapiens
MKVGWPGESCWQVGLAVEDSPALGAPRVGALPDVVPEGTLLNMVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVGTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKVPYDICRPDHSVLTLQLPVTASVREVMAALAQEDGWTKGQVLVKVNSAGDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 798290 - protein, 768 aa, Homo sapiens
SSPPPRLGLCPPVKHDWAFQDRDAQFYRFPGPEPEPVGTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKVPYDICRPDHSVLTLQLPVTASVREVMAALAQEDGWTKGQVLVKVNSAGDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 798291 - protein, 939 aa, Homo sapiens
MKVGWPGESCWQVGLAVEDSPALGAPRVGALPDVVPEGTLLNMVLRRMHRPRSCSYQLLLEHQRPSCIQGLRWTPLTNSEESLDFSESLEQASTERVLRAGRQLHRHLLATCPNLIRDRKYHLRLYRQCCSGRELVDGILALGLGVHSRSQVVGICQVLLDEGALCHVKHDWAFQDRDAQFYRFPGPEPEPVGTHEMEEELAEAVALLSQRGPDALLTVALRKPPGQRTDEELDLIFEELLHIKAVAHLSNSVKRELAAVLLFEPHSKAGTVLFSQGDKGTSWYIIWKGSVNVVTHGKGLVTTLHEGDDFGQLALVNDAPRAATIILREDNCHFLRVDKQDFNRIIKDVEAKTMRLEEHGKVVLVLERASQGAGPSRPPTPGRNRYTVMSGTPEKILELLLEAMGPDSSAHDPTETFLSDFLLTHRVFMPSAQLCAALLHHFHVEPAGGSEQERSTYVCNKRQQILRLVSQWVALYGSMLHTDPVATSFLQKLSDLVGRDTRLSNLLREQWPERRRCHRLENGCGNASPQMKARNLPVWLPNQDEPLPGSSCAIQVGDKVPYDICRPDHSVLTLQLPVTASVREVMAALAQEDGWTKGQVLVKVNSAGDAIGLQPDARGVATSLGLNERLFVVNPQEVHELIPHPDQLGPTVGSAEGLDLVSAKDLAGQLTDHDWSLFNSIHQVELIHYVLGPQHLRDVTTANLERFMRRFNELQYWVATELCLCPVPGPRAQLLRKFIKLAAHLKEQKNLNSFFAVMFGLSNSAISRLAHTWERLPHKVRKLYSALERLLDPSWNHRVYRLALAKLSPPVIPFMPLLLKDMTFIHEGNHTLVENLINFEKMRMMARAARMLHHCRSHNPVPLSPLRSRVSHLHEDSQVARISTCSEQSLSTRSPASTWAALAIILIFSKLMRFSTECVVSLMNEGHAFEKKGHEGDVA

SEQ ID NO: 798292 - protein, 109 aa, Homo sapiens
MPLLLKDMTFIHEGNHTLVENLINFEKMRMMARAARMLHHCRSHNPVPLSPLRSRVSHLHEDSQVARISTCSEQSLSTRSPASTWAYVQQLKVIDNQRELSRLSRELEP

SEQ ID NO: 798293 - protein, 435 aa, Homo sapiens
MDTASHSLVLLQQLNMQREFGFLCDCTVAIGDVYFKAHRAVLAAFSNYFKMIFIHQTSECIKIQPTDIQPDIFSYLLHIMYTGKGPKQIVDHSRLEEGIRFLHADYLSHIATEMNQVFSPETVQSSNLYGIQISTTQKTVVKQGLEVKEAPSSNSGNRAAVQGDHPQLQLSLAIGLDDGTADQQRACPATQALEEHQKPPVSIKQERCDPESVISQSHPSPSSEVTGPTFTENSVKIHLCHYCGERFDSRSNLRQHLHTHVSGSLPFGVPASILESNDLGEVHPLNENSEALECRRLSSFIVKENEQQPDHTNRGTTEPLQISQVSLISKDTEPVELNCNFSFSRKRKMSCTICGHKFPRKSQLLEHMYTHKGKSYRYNRCQRFGNALAQRFQPYCDSWSDVSLKSSRLSQEHLDLPCALESELTQENVDTILVE

SEQ ID NO: 798294 - protein, 131 aa, Homo sapiens
VIWISDSFFSRSLSVSCFKVISSFRTSTGLIIFSILAHSAHSAASSRSASSSSSTFSLRTSILERLWVSGDGMSLWGRIPGDPIHVMWTSYHMILPFWSQLIGPEMDDGHPTCKTTQPITSLVQGPHLARS

SEQ ID NO: 798295 - protein, 114 aa, Homo sapiens
MGWTMRLVTAALLLGLMMVVTGDEDENSPCAHEALLDEDTLFCQGLEVFYPELGNIGCKVVPDCNNYRQKITSWMEPIVKFPGAVDTVCLGHRAGFPRGPGEYPRGVFICMHES

SEQ ID NO: 798296 - protein, 227 aa, Homo sapiens
MGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 798297 - protein, 216 aa, Homo sapiens
HLNTELFVTTIMRPSNSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 798298 - protein, 241 aa, Homo sapiens
DPAALKFFLFQVVPMGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 798299 - protein, 227 aa, Homo sapiens; identical to SEQ ID NO: 798296

SEQ ID NO: 798300 - protein, 238 aa, Homo sapiens
VVPGYRCHHVPMGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 798301 - protein, 337 aa, Homo sapiens
LGRRRRRRAAAGLQPPGQLAATQKLRQGSPGRTWAQERTRALHCSRCPFRISIAPRARRPMSRRRAEPGCGGSGRRAGAPGEGRGRRRYAPGPAAKALPRRRLALQSQVPMGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKKGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 798302 - protein, 227 aa, Homo sapiens; identical to SEQ ID NO: 798296

SEQ ID NO: 798303 - protein, 72 aa, Homo sapiens
RALAGAGSSSNRRAGPLPTATSCPHRRAAGRASLPHRTTEEEVGFHSVTQAGVQWCDHSGDYKCAPHACLRT

SEQ ID NO: 798304 - protein, 232 aa, Homo sapiens
MEVLREKVEEEEEAEREEAAEWAEWARMEKMMRPVEVRKEEITLKQETLRDLEKKLSEIQITVSAELPAFTKDTIDISKLPISYKTNTPKEEHLLQVADNFSRQYSHLCPDRVPLFLHPLNECEVPKFVSTTLRPTLMPYPELYNWDSCAQFVSDFLTMVPLPDPLKPPRTCTPQTTVLKYQKGNCFDFSTLLCSMLIGSGYDAYCVNGYGSLDLCHMDLTREVCPLTVKPK

SEQ ID NO: 798305 - protein, 232 aa, Homo sapiens; identical to SEQ ID NO: 798304

SEQ ID NO: 798306 - protein, 232 aa, Homo sapiens; identical to SEQ ID NO: 798304

SEQ ID NO: 798307 - protein, 82 aa, Homo sapiens
CRYRLLKVKRKNKDGGCDNPMKCLGLGPEGSQLHPRLTGNQQSKPGSHQLNPEVGMLQSLQNRVKEESRNRRHWLHENRARL

SEQ ID NO: 798308 - protein, 179 aa, Homo sapiens
LPHPRHFQDSHPKATAPGFAPAFGTEEDGSLSQPGQSFPGLDGKKDFPRRRAGPDALGPGPFGRKRRKSRTAFTAQQVLELERRFVFQKYLAPSERDGLATRLGLANAQVVTWFQNRRAKLKRDVEEMRADVASLRALSPEVLCSLALPEGAPDPGLCLGPAGPDSRPHLSDEEIQVDD

SEQ ID NO: 798309 - protein, 355 aa, Homo sapiens
MGCRQSSEEKEAARRSRRIDRHLRSESQRQRREIKLLLLGTSNSGKSTIVKQMKIIHSGGFNLEACKEYKPLIIYNAIDSLTRIIRALAALRIDFHNPDRAYDAVQLFALTGPAESKGEITPELLGVMRRLWADPGAQACFSRSSEYHLEDNAAYYLNDLERIAAADYIPTVEDILRSRDMTTGIVENKFTFKELTFKMVDVGGQRSERKKWIHCFEGVTAIIFCVELSGYDLKLYEDNQTSRMAESLRLFDSICNNNWFINTSLILFLNKKDLLAEKIRRIPLTICFPEYKGQNTYEEAAVYIQRQFEDLNRNKETKEIYSHFTCATDTSNIQFVFDAVTDVIIQNNLKYIGLC

SEQ ID NO: 798310 - protein, 355 aa, Homo sapiens; identical to SEQ ID NO: 798309

SEQ ID NO: 798311 - protein, 90 aa, Homo sapiens
RPRLLPPPGNQGPSPSLLCSRDRSPQPRATGEAGAGAVGPAHRGGYPAGSPLLCGNRREDSARSPDKAWRISPARNLVGRQLRGCGPGYS

SEQ ID NO: 798312 - protein, 90 aa, Homo sapiens; identical to SEQ ID NO: 798311

SEQ ID NO: 798313 - protein, 262 aa, Homo sapiens
MGKTFSQLGSWREDENKSILSSKPAIGSKAVNYSSTGSSKSFCSCVPCEGTADASFVTCPTCQGSGKIPQELEKQLVALIPYGDQRLKPKHTKLFVFLAVLICLVTSSFIVFFLFPRSVIVQPAGLNSSTVAFDEADIYLNITNILNISNGNYYPIMVTQLTLEVLHLSLVVGQVSNNLLLHIGPLASEQMFYAVATKIRDENTYKICTWLEIKVHHVLLHIQGTLTCSYLSHSEQLVFQSYEYVDCRGNASVPHQLTPHPP

SEQ ID NO: 798314 - protein, 223 aa, Homo sapiens [sequence omitted]

SEQ ID NO: 798315 - protein, 124 aa, Homo sapiens
NWKKKFQKGVHRGEKSPGSTDLQTTTELSGECGETASHPDLTRNPHTPATLLLIQPERTPTPPPGGPPSWCWPVAEAVHGIPQVATAPHPPPSTLEGPSVADTMARFLFPTPVGLASDRSSSLH

SEQ ID NO: 798316 - protein, 104 aa, Homo sapiens
MEMMLDKKQIQVIFLFKFKMGHKAAETTRSINNAFGPEIANKGTVQWWFKNFCKGDESREDEECCARPSKVGNDQLRAIIEADPLTTLEVAENSTSTILRSFSI

SEQ ID NO: 798317 - protein, 104 aa, Homo sapiens; identical to SEQ ID NO: 798316

SEQ ID NO: 798318 - protein, 926 aa, Homo sapiens
MTTKDYPSLWGFGTTKTFKIPIEHLDFKYIEKCSDVKHLEKILCVLRSGEEGYYPELTEFCEKHLQALAPESRALRKDKPAATAASFTAEEWEKIDGDIKSWVSEIKKEEDKMHFHETETFPAMKDNLPPVRGSNSCLHVGKEKYSKRPTKKKTPRDYAEWDKFDVEKECLKIDEDYKEKTVIDKSHLSKIETRIDTAGLTEKEKDFLATREKEKGNEAFNSGDYEEAVMYYTRSISALPTVVAYNNRAQAEIKLQNWNSAFQDCEKVLELEPGNVKALLRRATTYKHQNKLREATEDLSKVLDVEPDNDLAKKTLSEVERDLKNSEAASETQTKGKRMVIQEIENSEDEEGKSGRKHEDGGGDKKPAEPAGAARAAQPCVMGNIQKKLTGKAEGGKRPARGAPQRGQTPEAGADKRSPRRASAAAAAGGGATGHPGGGQGAENPAGLKSQGNELFRSGQFAEAAGKYSAAIALLEPAGSEIADDLSILYSNRAACYLKEGNCSGCIQDCNRALELHPFSMKPLLRRAMAYETLEQYGKAYVDYKTVLQIDCGLQLANDSVNRLSRILMELDGPNWREKLSPIPAVPASVPLQAWHPAKEMISKQAGDSSSHRQQGITDEKTFKALKEEGNQCVNDKNYKDALSKYSECLKINNKECAIYTNRALCYLKLCQFEEAKQDCDQALQLADGNVKAFYRRALAHKGLKNYQKSLIDLNKVILLDPSIIEAKMELEEVTRLLNLKDKTAPFNKEKERRKIEIQEVNEGKEEPGRPAGEVSTGCLASEKGGKSSRSPEDPEKLPIAKPNNAYEFGQIINALSTRKDKEACAHLLAITAPKDLPMFLSNKLEGDTFLLLIQSLKNNLIEKDPSLVYQHLLYLSKAERFKMMLTLISKGQKELIEQLFEDLSDTPNNHFTLEDIQALKRQYEL

SEQ ID NO: 798319 - protein, 941 aa, Homo sapiens
VRRPRLPRRGALRSTMTTKDYPSLWGFGTTKTFKIPIEHLDFKYIEKCSDVKHLEKILCVLRSGEEGYYPELTEFCEKHLQALAPESRALRKDKPAATAASFTAEEWEKIDGDIKSWVSEIKKEEDKMHFHETETFPAMKDNLPPVRGSNSCLHVGKEKYSKRPTKKKTPRDYAEWDKFDVEKECLKIDEDYKEKTVIDKSHLSKIETRIDTAGLTEKEKDFLATREKEKGNEAFNSGDYEEAVMYYTRSISALPTVVAYNNRAQAEIKLQNWNSAFQDCEKVLELEPGNVKALLRRATTYKHQNKLREATEDLSKVLDVEPDNDLAKKTLSEVERDLKNSEAASETQTKGKRMVIQEIENSEDEEGKSGRKHEDGGGDKKPAEPAGAARAAQPCVMGNIQKKLTGKAEGGKRPARGAPQRGQTPEAGADKRSPRRASAAAAAGGGATGHPGGGQGAENPAGLKSQGNELFRSGQFAEAAGKYSAAIALLEPAGSEIADDLSILYSNRAACYLKEGNCSGCIQDCNRALELHPFSMKPLLRRAMAYETLEQYGKAYVDYKTVLQIDCGLQLANDSVNRLSRILMELDGPNWREKLSPIPAVPASVPLQAWHPAKEMISKQAGDSSSHRQQGITDEKTFKALKEEGNQCVNDKNYKDALSKYSECLKINNKECAIYTNRALCYLKLCQFEEAKQDCDQALQLADGNVKAFYRRALAHKGLKNYQKSLIDLNKVILLDPSIIEAKMELEEVTRLLNLKDKTAPFNKEKERRKIEIQEVNEGKEEPGRPAGEVSTGCLASEKGGKSSRSPEDPEKLPIAKPNNAYEFGQIINALSTRKDKEACAHLLAITAPKDLPMFLSNKLEGDTFLLLIQSLKNNLIEKDPSLVYQHLLYLSKAERFKMMLTLISKGQKELIEQLFEDLSDTPNNHFTLEDIQALKRQYEL

SEQ ID NO: 798320 - protein, 884 aa, Homo sapiens
VRRPRLPRRGALRSTMTTKDYPSLWGFGTTKTFKIPIEHLDFKYIEKCSDVKHLEKILCVLRSGEEGYYPELTEFCEKHLQALAPESRALRKDKPAATAASFTAEEWEKIDGDIKSWVSEIKKEEDKMHFHETETFPAMKDNLPPVRGSNSCLHVGKEKYSKRPTKKKTPRDYAEWDKFDVEKECLKIDEDYKEKTVIDKSHLSKIETRIDTAGLTEKEKDFLATREKEKGNEAFNSGDYEEAVMYYTRSISALPTVVAYNNRAQAEIKLQNWNSAFQDCEKVLELEPGNVKALLRRATTYKHQNKLREATEDLSKVLDVEPDNDLAKKTLSEVERDLKNSEAASETQTKGKRMVIQEIENSEDEEGKSGRKHEDGGGDEDAAAAAGGGATGHPGGGQGAENPAGLKSQGNELFRSGQFAEAAGKYSAAIALLEPAGSEIADDLSILYSNRAACYLKEGNCSGCIQDCNRALELHPFSMKPLLRRAMAYETLEQYGKAYVDYKTVLQIDCGLQLANDSVNRLSRILMELDGPNWREKLSPIPAVPASVPLQAWHPAKEMISKQAGDSSSHRQQGITDEKTFKALKEEGNQCVNDKNYKDALSKYSECLKINNKECAIYTNRALCYLKLCQFEEAKQDCDQALQLADGNVKAFYRRALAHKGLKNYQKSLIDLNKVILLDPSIIEAKMELEEVTRLLNLKDKTAPFNKEKERRKIEIQEVNEGKEEPGRPAGEVSTGCLASEKGGKSSRSPEDPEKLPIAKPNNAYEFGQIINALSTRKDKEACAHLLAITAPKDLPMFLSNKLEGDTFLLLIQSLKNNLIEKDPSLVYQHLLYLSKAERFKMMLTLISKGQKELIEQLFEDLSDTPNNHFTLEDIQALKRQYEL

SEQ ID NO: 798321 - protein, 857 aa, Homo sapiens
VRRPRLPRRGALRSTMTTKDYPSLWGFGTTKTFKIPIEHLDFKYIEKCSDVKHLEKILCVLRSGEEGYYPELTEFCEKHLQALAPESRALRKDKPAATAASFTAEEWEKIDGDIKSWVSEIKKEEDKMHFHETETFPAMKDNLPPVRGSNSCLHVGKEKYSKRPTKKKTPRDYAEWDKFDVEKECLKIDEDYKEKTVIDKSHLSKIETRIDTAGLTEKEKDFLATREKEKGNEAFNSGDYEEAVMYYTRSISALPTVVAYNNRAQAEIKLQNWNSAFQDCEKVLELEPGNVKALLRRATTYKHQNKLREATEDLSKVLDVEPDNDLAKKTLSEVERDLKNSEAASETQTKGKRMVIQEIENSEDEEGKSGRKHEDGGGDKKPAEPAGAARAAQPCVMGNIQKKLTGKAEGGKRPARGAPQRGQTPEAGADKRSPRRASAAAAAGGGATGHPGGGQGAENPAGLKSQGNELFRSGQFAEAAGKYSAAIALLEPAGYQEFYMELDGPNWREKLSPIPAVPASVPLQAWHPAKEMISKQAGDSSSHRQQGITDEKTFKALKEEGNQCVNDKNYKDALSKYSECLKINNKECAIYTNRALCYLKLCQFEEAKQDCDQALQLADGNVKAFYRRALAHKGLKNYQKSLIDLNKVILLDPSIIEAKMELEEVTRLLNLKDKTAPFNKEKERRKIEIQEVNEGKEEPGRPAGEVSTGCLASEKGGKSSRSPEDPEKLPIAKPNNAYEFGQIINALSTRKDKEACAHLLAITAPKDLPMFLSNKLEGDTFLLLIQSLKNNLIEKDPSLVYQHLLYLSKAERFKMMLTLISKGQKELIEQLFEDLSDTPNNHFTLEDIQALKRQYEL

SEQ ID NO: 798322 - protein, 424 aa, Homo sapiens
MVCNIFVFFRALELHPFSMKPLLRRAMAYETLEQYGKAYVDYKTVLQIDCGLQLANDSVNRLSRILMELDGPNWREKLSPIPAVPASVPLQAWHPAKEMISKQAGDSSSHRQQGITDEKTFKALKEEGNQCVNDKNYKDALSKYSECLKINNKECAIYTNRALCYLKLCQFEEAKQDCDQALQLADGNVKAFYRRALAHKGLKNYQKSLIDLNKVILLDPSIIEAKMELEEVTRLLNLKDKTAPFNKEKERRKIEIQEVNEGKEEPGRPAGEVSTGCLASEKGGKSSRSPEDPEKLPIAKPNNAYEFGQIINALSTRKDKEACAHLLAITAPKDLPMFLSNKLEGDTFLLLIQSLKNNLIEKDPSLVYQHLLYLSKAERFKMMLTLISKGQKELIEQLFEDLSDTPNNHFTLEDIQALKRQYEL

SEQ ID NO: 798323 - protein, 845 aa, Homo sapiens
VRRPRLPRRGALRSTMTTKDYPSLWGFGTTKTFKIPIEHLDFKYIEKCSDVKHLEKILCVLRSGEEGYYPELTEFCEKHLQALAPESRALRKDKPAATAASFTAEEWEKIDGDIKSWVSEIKKEEDKMHFHETETFPAMKDNLPPVRGSNSCLHVGKEKYSKRPTKKKTPRDYAEWDKFDVEKECLKIDEDYKEKTVIDKSHLSKIETRIDTAGLTEKEKDFLATREKEKGNEAFNSGDYEEAVMYYTRSISALPTVVAYNNRAQAEIKLQNWNSAFQDCEKVLELEPGNVKALLRRATTYKHQNKLREATEDLSKVLDVEPDNDLAKKTLSEVERDLKNSEAASETQTKGKRMVIQEIENSEDEEGKSGRKHEDGGGDEDAAAAAGGGATGHPGGGQGAENPAGLKSQGNELFRSGQFAEAAGKYSAAIALLEPAGSEIADDLSILYSNRAACYLKEGNCSGCIQDCNRALELHPFSMKPLLRRAMAYETLEQYGKAYVDYKTVLQIDCGLQLANDSVNRLSRILMELDGPNWREKLSPIPAVPASVPLQAWHPAKEMISKQAGDSSSHRQQGITDEKTFKALKEEGNQCVNDKNYKDALSKYSECLKINNKECAIYTNRALCYLKLCQFEEAKQDCDQALQLADGNVKAFYRRALAHKGLKNYQKSLIDLNKVILLDPSIIEAKMELEEVTRLLNLKDKTAPFNKEKERRKIEIQEVNEGKEEPGRPAGEVSTGCLASEKGGKSSRSPEDPEKLPIAKPNNAYEFGQIINALSTRKDKEACAHLLAITAPKDLPMFLSNKLEGDTFLLLIQSLKNNLIEKDPSLVYQHLLYLSKAERFKFTTF

SEQ ID NO: 798324 - protein, 69 aa, Homo sapiens
GLSSLVGVTWGLAIFTPLGLSTVYIFALFNSLQGVFICCWFTILYLPSQSTTVSSSTARLDQAHSASQE

SEQ ID NO: 798325 - protein, 444 aa, Homo sapiens
ALTHSLVLHYGLYKKMIVFKPYQASQHDMCRFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 798326 - protein, 223 aa, Homo sapiens
MYEVGAESGRYYCLNVPLRDGIDDQSYKHLFQPVINQVVDFYQPTCIVLQCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 798327 - protein, 371 aa, Homo sapiens
MCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 798328 - protein, 97 aa, Homo sapiens
STHGTGWGWRRPRAAGGGGAGPAPAGTMAKTVAYFYDPDVGNFHYGAGHPMKPHRLALTHSLVLHYGLYKKMIVSSAASAGGWGVGRAVAVGIGGLD

SEQ ID NO: 798329 - protein, 426 aa, Homo sapiens
MARRGYFYTDVGRFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 798330 - protein, 428 aa, Homo sapiens
MAKTVAYFYDPDVGNFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 798331 - protein, 241 aa, Homo sapiens
MTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 798332 - protein, 552 aa, Homo sapiens
MAKTVAYFYDPDVGNFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSKYRSLPSVPRPLLFLLEITSSAWYCLLLGQLSLRMNGLQRDHESLENCMQHIMCMCIFLGKVIGFHQSLIAVWDPFQKFQTSDLILLGGPFPGLHARSTPFFLLFPVSPSPVGCQVPIFGPLPGYKHLFQPVINQVVDFYQPTCIVLQCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 798333 - protein, 434 aa, Homo sapiens
MAKTVAYFYDPDVGNFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRSGSRDFSLLSIGLLGRFKREKVNGKVLV

SEQ ID NO: 798334 - protein, 154 aa, Homo sapiens
STHGTGWGWRRPRAAGGGGAGPAPAGTMAKTVAYFYDPDVGNFHYGAGHPMKPHRLALTHSLVLHYGLYKKMIVFKPYQASQHDMCRFHSEDYIDVELTLWAVIDWAALTSASEGMGNALNMSRASISLYSCWVVVVILSEMLPAAGHMRHRCW

SEQ ID NO: 798335 - protein, 157 aa, Homo sapiens
MVPFNRECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 798336 - protein, 127 aa, Homo sapiens
MSRASISLYSCWVVVVILSEMLPAAEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 798337 - protein, 280 aa, Homo sapiens
MAKTVAYFYDPDVGNFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQVILSVPPQECSAWAWGKRAREEEVL

SEQ ID NO: 798338 - protein, 79 aa, Homo sapiens
MGKRQLGDSMSWESLETAHSVFLISNQYLDQIRQTIFENLKMLNHAPSVQIHDVPADLLTYDRTDEADAEERGPEENYS

SEQ ID NO: 798339 - protein, 428 aa, Homo sapiens; identical to SEQ ID NO: 798330

SEQ ID NO: 798340 - protein, 428 aa, Homo sapiens; identical to SEQ ID NO: 798330

SEQ ID NO: 798341 - protein, 233 aa, Homo sapiens
STHGTGRGWRRPRAAGGGGAGPAPAGTMAKTVAYFYDPDVGNFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGHV

SEQ ID NO: 798342 - protein, 428 aa, Homo sapiens; identical to SEQ ID NO: 798330

SEQ ID NO: 798343 - protein, 371 aa, Homo sapiens; identical to SEQ ID NO: 798327

SEQ ID NO: 798344 - protein, 280 aa, Homo sapiens; identical to SEQ ID NO: 798337

SEQ ID NO: 798345 - protein, 333 aa, Homo sapiens
STHGTGRGWRRPRAAGGGGAGPAPAGTMAKTVAYFYDPDVGNFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVLGGGGYTVRNVARC

SEQ ID NO: 798346 - protein, 237 aa, Homo sapiens
MCRFHSEDYIDFLQRVSPTNMQGFTKSLNAFNVGDDCPVFPGLFEFCSRYTGASLQGATQLNNKCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 798347 - protein, 156 aa, Homo sapiens
APDPNCVTVTGLPENVEEAIDHILNLEEEYLLTCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 798348 - protein, 327 aa, Homo sapiens
STHGTGRGWRRPRAAGGGGAGPAPAGTMAKTVAYFYDPDVGNFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVLGGGGYTI

SEQ ID NO: 798349 - protein, 240 aa, Homo sapiens
MAKTVAYFYDPDVGNFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSKYRSLPSVP

SEQ ID NO: 798350 - protein, 248 aa, Homo sapiens
APAAQPVIALRPSPAPSAPHGGWSGRGKEKVRLGVITNPSPEGEETGIQQRRAAAGRSHLEMESRPTPSSSTSSSSSSFSSSHPGSLPKPLGLQPLPRPEVSFLTEYLRKLKACEGGGVEIAAASFPRIYLMGMCSRQDRIQKDIDVVIQKSRAEDCLFAGEFLLFQNLGPRAPFPVLRPRRVCLGQLLALRAEPAWPERGSRRRGSAWYFQPRVVPEACKHASWVPAAAAERGWLDPPGLRNGLSRR

SEQ ID NO: 798351 - protein, 168 aa, Homo sapiens
APAAQPVIALRPSPAPSAPHGGWSGRGKEKVRLGVITNPSPEGEETGIQQRRAAAGRSHLEMESRPTPSSSTSSSSSSFSSSHPGSLPKPLGLQPLPRPEVSFLTEYLRKLKACEGGGVEIAAASFPRIYLMGMCSRQDRIQKDIDVVIQKSRAEDCLFAGVKAILKA

SEQ ID NO: 798352 - protein, 172 aa, Homo sapiens
APAAQPVIALRPSPAPSAPHGGWSGRGKEKVRLGVITNPSPEGEETGIQQRRAAAGRSHLEMESRPTPSSSTSSSSSSFSSSHPGSLPKPLGLQPLPRPEVSFLTEYLRKLKACEGGGVEIAAASFPRIYLMGMCSRQDRIQKDIDVVIQKSRAEDCLFADFRYSDSTFTFT

SEQ ID NO: 798353 - protein, 487 aa, Homo sapiens
RSCCYCDLSGHGPGCCGCRGEMAEAEGVPTTPGPASGSTFRGRRDVSGSWERDQQVEAAQRALVEVLGPYEPLLSRVQAALVWERPARSALWCLGLNAAFWFFALTSLRLVFLLAFGLMIIVCIDQWKNKIWPEIKVPRPDALDNESWGFVHPRLLSVPELCHHVAEVWVSGTIFIRNVLLFKKQNPGKFCLLSCGILTFLAVLGRYVPGLLLSYLMLVTVMMWPLAVYHRLWDRAYVRLKPALQRLDFSVRGYMMSKQRERQLRRRALHPERAMDNHSDSEEELAAFCPQLDDSTVARELAITDSEHSDAEVSCTDNGTFNLSRGQTPLTEGSEDLDGHSDPEESFARDLPDFPSINMDPAGLDDEDDTSIGMPSLMYRSPPGAEEPQAPPASRDEAALPELLLGALPVGSNLTSNLASLVSQGMIQLALSGASQPGPSGAPAQRATRGFLRSPSSDLDTDAEGDDFELLDQSELSQLDPASSRSH

SEQ ID NO: 798354 - protein, 413 aa, Homo sapiens
FRESKRQGSLSSLYLNSDFNLVSQEESHASPPKHLGLVTPQTPFKTGSTGCLHSKMGGPSTPSFHSSPFSSHSWGFVHPRLLSVPELCHHVAEVWVSGTIFIRNVLLFKKQNPGKFCLLSCGILTFLAVLGRYVPGLLLSYLMLVTVMMWPLAVYHRLWDRAYVRLKPALQRLDFSVRGYMMSKQRERQLRRRALHPERAMDNHSDSEEELAAFCPQLDDSTVARELAITDSEHSDAEVSCTDNGTFNLSRGQTPLTEGSEDLDGHSDPEESFARDLPDFPSINMDPAGLDDEDDTSIGMPSLMYRSPPGAEEPQAPPASRDEAALPELLLGALPVGSNLTSNLASLVSQGMIQLALSGASQPGPSGAPAQRATRGFLRSPSSDLDTDAEGDDFELLDQSELSQLDPASSRSH

SEQ ID NO: 798355 - protein, 293 aa, Homo sapiens
RSCCYCDLSGHGPGCCGCRGEMAEAEGVPTTPGPASGSTFRGRRDVSGSWERDQQVEAAQRALVEVLGPYEPLLSRVQAALVWERPARSALWCLGLNAAFWFFALTSLRLVFLLAFGLMIIVCIDQWKNKIWPEIKVPRPDALDNESWGFVHPRLLSVPELCHHVAEVWVSGTIFIRNVLLFKKQNPGKFCLLSCGILTFLAVLGRYVPGLLLSYLMLVTVMMWPLAVYHRLWDRAYVRLKPALQRLDFSVRGYMMSKQRERQLRRRALHPERAMDNHSDSEEELAAFCPQVS

SEQ ID NO: 798356 - protein, 181 aa, Homo sapiens
RSCCYCDLSGHGPGCCGCRGEMAEAEGVPTTPGPASGSTFRGRRDVSGSWERDQQVEAAQRALVEVLGPYEPLLSRVQAALVWERPARSALWCLGLNAAFWFFALTSLRLVFLLAFGLMIIVCIDQWKNKIWPEIKVPRPDALDNERYGTLIKSLFVALIHSLVIFWLHVVNPMFWTHSVN

SEQ ID NO: 798357 - protein, 271 aa, Homo sapiens
MLVTVMMWPLAVYHRLWDRAYVRLKPALQRLDFSVRGYMMSKQRERQLRRRALHPERAMDNHSDSEEELAAFCPQLDDSTVARELAITDSEHSDAEVSCTDNGTFNLSRGQTPLTEGSEDLDGHSDPEESFARDLPDFPSINMDPAGLDDEDDTSIGMPSLMYRSPPGAEEPQAPPASRDEAALPELLLGALPVGSNLTSNLASLVSQGMIQLALSGASQPGPSGAPAQRATRGFLRSPSSDLDTDAEGDDFELLDQSELSQLDPASSRSH

SEQ ID NO: 798358 - protein, 170 aa, Homo sapiens
ALEDPSGALPSPLTEGSEDLDGHSDPEESFARDLPDFPSINMDPAGLDDEDDTSIGMPSLMYRSPPGAEEPQAPPASRDEAALPELLLGALPVGSNLTSNLASLVSQGMIQLALSGASQPGPSGAPAQRATRGFLRSPSSDLDTDAEGDDFELLDQSELSQLDPASSRSH

SEQ ID NO: 798359 - protein, 580 aa, Homo sapiens [sequence omitted]

SEQ ID NO: 798360 - protein, 715 aa, Homo sapiens [sequence omitted]

SEQ ID NO: 798361 - protein, 715 aa, Homo sapiens [sequence omitted]

SEQ ID NO: 798362 - protein, 468 aa, Homo sapiens
MAKLYMVSDASGSMRVTVVAEENPFSMAMLLSEECFILDHGAAKQIFVWKGKDANPQERKAAMKTAEEFLQQMNYSKNTQIQVLPEGGETPIFKQFFKDWRDKDQSDGFGKVYVTEKVAQIKQIPFDASKLHSSPQMAAQHNMVDDGSGKVEIWRVENNGRIQVDQNSYGEFYGGDCYIILYTYPRGQIIYTWQGANATRDELTTSAFLTVQLDRSLGGQAVQIRVSQGKEPVHLLSLFKDKPLIIYKNGTSKKGGQAPAPPTRLFQVRRNLASITRIVEVDVDANSLNSNDVFVLKLPQNSGYIWVGKGASQEEEKGAEYVASVLKCKTLRIQEGEEPEEFWNSLGGKKDYQTSPLLETQAEDHPPRLYGCSNKTGRFVIEEIPGEFTQDDLAEDDVMLLDAWEQIFIWIGKDANEVEKKESLKSAKMYLETDPSGRDKRTPIVIIKQGHEPPTFTGWFLGWDSSKW

SEQ ID NO: 798363 - protein, 344 aa, Homo sapiens
MARELYHEEFARAGKQAGLQVWRIEKLELVPVPQSAHGDFYVGDAYLVLHTAKTSRGFTYRLHFWLGKECSQDESTAAAIFTVQMDDYLGGKPVQNRELQGYESNDFVSYFKGGLKYKAGGVASGLNHVLTNDLTAKRLLHVKGRRVVRATEVPLSWDSFNKGDCFIIDLGTEIYQWCGSSCNKYERLKANQVATGIRYNERKGRSELIVVEEGSEPSELIKVLGEKPELPDGGDDDDIIADISNRKMAKLYMVSDASGSMRVTVVAEENPFSMAMLLSEECFILDHGAAKQIFVWKGKDANPQERKAAMKTAEEFLQQMNYSKNTQVCVKLNWLEKNRKHWSS

SEQ ID NO: 798364 - protein, 648 aa, Homo sapiens
MEGAGYRVVFEKGGVYLHTSAKKYQDRDSLIAGVIRVVEKDNDVLLHWAPVEEAGDSTQILFSKKDSSGGDSCASEEEPTFDPGYEPDWAVISTVRPQPCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 798365 - protein, 44 aa, Homo sapiens
MEGAGYRVSTEDAFPRFSVCETPRLVISSSLRPWLSRIRHGLGK

SEQ ID NO: 798366 - protein, 118 aa, Homo sapiens
MPVPKEHPGLWLIRLTLASHALPPTQCRLPRCRAQLPPGLLGLLSESGGAKVHPPLQARPQLGLPGSGDPGWRFPARTALPPRGHPRPAPRPQPLPAVGQVSSLPVLGLKPGPVPPWL

SEQ ID NO: 798367 - protein, 648 aa, Homo sapiens; identical to SEQ ID NO: 798364

SEQ ID NO: 798368 - protein, 650 aa, Homo sapiens
SPRWFPPTQVVFEKGGVYLHTSAKKYQDRDSLIAGVIRVVEKDNDVLLHWAPVEEAGDSTQILFSKKDSSGGDSCASEEEPTFDPGYEPDWAVISTVRPQPCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 798369 - protein, 659 aa, Homo sapiens
TTTKFAAAATYVKEPATWVVFEKGGVYLHTSAKKYQDRDSLIAGVIRVVEKDNDVLLHWAPVEEAGDSTQILFSKKDSSGGDSCASEEEPTFDPGYEPDWAVISTVRPQPCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 798370 - protein, 554 aa, Homo sapiens
MEGAGYRVVFEKGGVYLHTSAKKYQDRDSLIAGVIRVVEKDNDVLLHWAPVEEAGDSTQILFSKKDSSGGDSCASEEEPTFDPGYEPDWAVISTVRPQPCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVGQPVWARGLKGWAHLPWEVGRRGTDPGGTSGPGWAMTSL

SEQ ID NO: 798371 - protein, 635 aa, Homo sapiens
AGITGVSHRTRPAVPSLCLSFPLYSMGLSSRVASRLRSESMAPYCLLLSSPKDSSGGDSCASEEEPTFDPGYEPDWAVISTVRPQPCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 798372 - protein, 662 aa, Homo sapiens
MEGAGYRVVFEKGGVYLHTSAKKYQDRDSLIAGVIRVVEKDNDVLLHWAPVEEAGDSTQILFSKKDSSGGDSCASEEEPTFDPGYEPDWAVISTVRPQPCHSEPTRGRLRWRPLRSTCGPGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 798373 - protein, 299 aa, Homo sapiens [sequence omitted]

SEQ ID NO: 798374 - protein, 532 aa, Homo sapiens
MCPPLGSSCGPPLTAFPEMRGCPGVVGTLQLEPMSAEHRQPGTLGPYLCITCASPPASQLSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 798375 - protein, 562 aa, Homo sapiens
MCPPLGSSCGPPLTAFPEMRGCPGVVGTLQLEPMSAEHRQPGTLGPYLCITCASPPASQLSPQDSRLYLVFPHDSSALSNSFHHLQLFDQDSSNVVSVSVPQQEAWRLWAGRDEKGRVVTSLCPRPQRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 798376 - protein, 433 aa, Homo sapiens
MNLTGLSSALCGHSPATQSPRELQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 798377 - protein, 295 aa, Homo sapiens
PPKVLGLQACAIAPGLQLKFLLTAYLGVSVPLALTSSGQRSVSSGVLGVLPPFHVHGRCGSIIAHFLWRVGGRRGRARVQGCSCLTSEVPQPGISHLPRLGEGLPVRMTSQTLSPALGKAEWAPCHPPDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 798378 - protein, 159 aa, Homo sapiens
IFLVETRFLHIGQAGLELPTSGDPPASASQSAGITGVSHRTRPAVPSLCLSFPLYSMGLSSRVASRLRSESMAPYCLLLSSPKDSSGGDSCASEEEPTFDPGYEPDWAVISTVRPQPCHSEPTRGRLRWRPLRSTCGPGRTHLALSGHGPKGFAAHNQE

SEQ ID NO: 798379 - protein, 262 aa, Homo sapiens
MEGAGYRVVFEKGGVYLHTSAKKYQDRDSLIAGVIRVVEKDNDVLLHWAPVEEAGDSTQILFSKKIPRTPALSASVSGGCSSGSRGNSPSRMSFGCGRCCGQGSLAPICTCWWPAPSWTWRGTPSCCPASAPMRSSSTKHRVGARAEVVECRLAPDPPPPAAHQRADYEAERGGRADPRRGPAPPANRLPRAAHNVQEILGGPGPRRGKRRQYAPSAKPDFGRTTTVCRAYPHTAGLNTNANHQQDHSTITTHKEQRKHQHD

SEQ ID NO: 798380 - protein, 673 aa, Homo sapiens
MEGAGYRVVFEKGGVYLHTSAKKYQDRDSLIAGVIRVVEKDNDVLLHWAPVEEAGDSTQILFSKKDSSGGDSCASEEEPTFDPGYEPDWAVISTVRPQPCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHEAQSGRSGRRWLSADWRLTHPLPQHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 798381 - protein, 653 aa, Homo sapiens
MEGAGYRVVFEKGGVYLHTSAKKYQDRDSLIAGVIRVVEKDNDVLLHWAPVEEAGDSTQILFSKKDSSGGDSCASEEEPTFDPGYEPDWAVISTVRPQPCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHEAQSGRSGRRWLSADWRLTHPLPQHINELTMKLSVEDVLTRADALHGHSPAARQQPGDPARGGGRGRRLLTPPGSLVLHRHFSPSQAHLRGGRCAPPPC

SEQ ID NO: 798382 - protein, 555 aa, Homo sapiens
MEGAGYRVVFEKGGVYLHTSAKKYQDRDSLIAGVIRVVEKDNDVLLHWAPVEEAGDSTQILFSKKDSSGGDSCASEEEPTFDPGYEPDWAVISTVRPQPCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKAL

SEQ ID NO: 798383 - protein, 659 aa, Homo sapiens
SVTARGYGIGGDYEGASQVVFEKGGVYLHTSAKKYQDRDSLIAGVIRVVEKDNDVLLHWAPVEEAGDSTQILFSKKDSSGGDSCASEEEPTFDPGYEPDWAVISTVRPQPCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 798384 - protein, 666 aa, Homo sapiens
MEGAGYRVVFEKGGVYLHTSAKKYQDRDSLIAGVIRVVEKDNDVLLHWAPVEEAGDSTQILFSKKPNTAKAPGSVRYITSAFQDSSGGDSCASEEEPTFDPGYEPDWAVISTVRPQPCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 798385 - protein, 595 aa, Homo sapiens
MGSSSLSEDYRQCLERELRRGRAGVCGDPSLRAVLWQILVEDFDLHGALQDDALALLTDGLWGRADLAPALRGLARAFELLELAAVHLYLLPWRKEFTTIKTFSGGYVHVLKGVLSDDLLLKSFQKMGYVRRDSHRLMVTALPPACQLVQVALGCFALRLECEILGEVLAQLGTSVLPAEELLQARRASGDVASCVAWLQQRLAQDEEPPPLPPRGSPAAYRAPLDLYRDLQEDEGSEDASLYGEPSPGPDSPPAELAYRPPLWEQSAKLWGTGGRAWEPPAEELPQASSPPYGALEEGLEPEPSAFSFLSLRRELSRPGDLATPESSAAASPRRIRAEGVPASAYRSVSEPPGYQAHSCLSPGALPTLCCDTCRQLHAAHCAALPACRPGHSLRVLLGDAQRRLWLQRAQMDTLLYNSPGAGPRPAGPQVKGSWETAPVVLLFAGEGSGPLVALSLGESWAQQGVGESRPTLAGGGTLCIWKAPRAAGLSRPAGAFPHFPTLGTQTHAHMCWVEGSSLFQPVPEPVPEKDPVPQGPWLLACSLQYGVRGSGLGGPPRVPGILHTSVLKGLLVTPSSPHPKLCWSQSAGLCRVHG

SEQ ID NO: 798386 - protein, 623 aa, Homo sapiens
SGTPGGSARRAGRPELIRGGRRPLGTDRMGSSSLSEDYRQCLERELRRGRAGVCGDPSLRAVLWQILVEDFDLHGALQDDALALLTDGLWGRADLAPALRGLARAFELLELAAVHLYLLPWRKEFTTIKTFSGGYVHVLKGVLSDDLLLKSFQKMGYVRRDSHRLMVTALPPACQLVQVALGCFALRLECEILGEVLAQLGTSVLPAEELLQARRASGDVASCVAWLQQRLAQDEEPPPLPPRGSPAAYRAPLDLYRDLQEDEGSEDASLYGEPSPGPDSPPAELAYRPPLWEQSAKLWGTGGRAWEPPAEELPQASSPPYGALEEGLEPEPSAFSFLSLRRELSRPGDLATPESSAAASPRRIRAEGVPASAYRSVSEPPGYQAHSCLSPGALPTLCCDTCRQLHAAHCAALPACRPGHSLRVLLGDAQRRLWLQRAQMDTLLYNSPGAGPRPAGPQVKGSWETAPVVLLFAGEGSGPLVALSLGESWAQQGVGESRPTLAGGGTLCIWKAPRAAGLSRPAGAFPHFPTLGTQTHAHMCWVEGSSLFQPVPEPVPEKDPVPQGPWLLACSLQYGVRGSGLGGPPRVPGILHTSVLKGLLVTPSSPHPKLCWSQSAGLCRVHG

SEQ ID NO: 798387 - protein, 180 aa, Homo sapiens
SGTPGGSARRAGRPELIRGGRRPLGTDRMGSSSLSEDYRQCLERELRRGRAGVCGDPSLRAVLWQILVEDFDLHGALQDDALALLTDGLWGRADLAPALRGLARAFELLELAAVHLYLLPWRKEFTTIKTFSGGYVHVLKGVLSDDLLLKSFQKMGYVRRDSHRLMLCWSQSAGLCRVHG

SEQ ID NO: 798388 - protein, 443 aa, Homo sapiens
MNLSIAIPAMVNNTAPPSQPNASTERPSTDSQGYWNETLKEFKAMAPAYDWSPEIQGIILSSLNYGSFLAPIPSGYVAGIFGAKYVVGAGLFISSFLTLFIPLAANAGVALLIVLRIVQGIAQVMVLTGQYSIWVKWAPPLERSQLTTIAGSGSMLGSFIVLLAGGLLCQTIGWPYVFYIFGGIGCACCPLWFPLIYDDPVNHPFISAGEKRYIVCSLAQQDCSPGWSLPIRAMIKSLPLWAILVSYFCEYWLFYTIMAYTPTYISSVLQANLRDSGILSALPFVVGCICIILGGLLADFLLSRKILRLITIRKLFTAIGVLFPSVILVSLPWVRSSHSMTMTFLVLSSAISSFCESGALVNFLDIAPRYTGFLKGLLQVFAHIAGAISPTAAGFFISQDSEFGWRNVFLLSAAVNISGLVFYLIFGRADVQDWAKEQTFTHL

SEQ ID NO: 798389 - protein, 68 aa, Homo sapiens
DCAVTSVIIVHSGSQRKRLSADIVIPTFLMRWHRSSHSMTMTFLVLSSAISSFCESGALVNFLDIAPR

SEQ ID NO: 798390 - protein, 497 aa, Homo sapiens
MSTGPDVKATVGDISSDGNLNVAQEECSRKGFCSVRHGLALILQLCNFSIYTQQMNLSIAIPAMVNNTAPPSQPNASTERPSTDSQGYWNETLKEFKAMAPAYDWSPEIQGIILSSLNYGSFLAPIPSGYVAGIFGAKYVVGAGLFISSFLTLFIPLAANAGVALLIVLRIVQGIAQVMVLTGQYSIWVKWAPPLERSQLTTIAGSGSMLGSFIVLLAGGLLCQTIGWPYVFYIFGGIGCACCPLWFPLIYDDPVNHPFISAGEKRYIVCSLAQQDCSPGWSLPIRAMIKSLPLWAILVSYFCEYWLFYTIMAYTPTYISSVLQANLRDSGILSALPFVVGCICIILGGLLADFLLSRKILRLITIRKLFTAIGVLFPSVILVSLPWVRSSHSMTMTFLVLSSAISSFCESGALVNFLDIAPRYTGFLKGLLQVFAHIAGAISPTAAGFFISQDSEFGWRNVFLLSAAVNISGLVFYLIFGRADVQDWAKEQTFTHL

SEQ ID NO: 798391 - protein, 497 aa, Homo sapiens; identical to SEQ ID NO: 798390

SEQ ID NO: 798392 - protein, 114 aa, Homo sapiens
MSTGPDVKATVGDISSDGNLNVAQEECSRKGFCSVRHGLALILQLCNFSIYTQQMNLSIAIPAMVNNTAPPSQPNASTERPSTDSQGYWNETLKEFKAMVSLMRLWTLSLTQII

SEQ ID NO: 798393 - protein, 718 aa, Homo sapiens
MELLDMVCMDPLVDDNDDILNMVIVIHSLLDICSVISSMDHAFHANTWKFIIKQSLKHQSIIKSQLKHKDIITSLCEDILFSFHSCLQLAEQMTQSDAQDNADYRLFQKTLKLCRFFANSLLHYAKEFLPFLSDSCCTLHQLYLQIHSKFPPSLYATRISKAHQEEIAGAFLVTLDPLISQLLTFQPFMQVVLDSKLDLPCELQFPQCLLLVVVMDKLPSQPKEVQTLWCTDSQVSETTTRISLLKAVFYSFEQCSGELSLPVHLQGLKSKGKAEVAVTLYQHVCVHLCTFITSFHPSLFAELDAALLNAVLSANMITSLLAMDAWCFLARYGTAELCAHHVTIVAHLIKSCPGECYQLINLSILLKRLFFFMAPPHQLEFIQKFSPKEAENLPLWQHISFQALPPELREQTVHEVTTVGTAECRKWLSRSRTLGELESLNTVLSALLAVCNSAGEALDTGKQTAIIEVVSQLWAFLNIKQVADQPYVQQTFSLLLPLLGFFIQTLDPKLILQAVTLQTSLLKLELPDYVRLAMLDFVSSLGKLFIPEAIQDRILPNLSCMFALLLADRSWLLEQHTLEAFTQFAEGTNHEEIVPQCLSSEETKNKVVSFLEKTGFVDETEAAKVERVKQEKGIFWEPFANVTVEEAKRSSLQPYAKRARQEFPWEEEYRSALHTIAGALEATESLLQKGPAPAWLSMEMEALQERMDKLKRYIHTLG

SEQ ID NO: 798394 - protein, 853 aa, Homo sapiens
MFLPHMNHLTLEQTFFSQVLPKTVKLFDDMMYELTSQARGLSSQNLEIQTTLRNILQTMVQLLGALTGCVQHICATQESIILENIQSLPSSVLHIIKSTFVHCKNSESVYSGCLHLVSDLLQALFKEAYSLQKQLMELLDMVCMDPLVDDNDDILNMVIVIHSLLDICSVISSMDHAFHANTWKFIIKQSLKHQSIIKSQLKHKDIITSLCEDILFSFHSCLQLAEQMTQSDAQDNADYRLFQKTLKLCRFFANSLLHYAKEFLPFLSDSCCTLHQLYLQIHSKFPPSLYATRISKAHQEEIAGAFLVTLDPLISQLLTFQPFMQVVLDSKLDLPCELQFPQCLLLVVVMDKLPSQPKEVQTLWCTDSQVSETTTRISLLKAVFYSFEQCSGELSLPVHLQGLKSKGKAEVAVTLYQHVCVHLCTFITSFHPSLFAELDAALLNAVLSANMITSLLAMDAWCFLARYGTAELCAHHVTIVAHLIKSCPGECYQLINLSILLKRLFFFMAPPHQLEFIQKFSPKEAENLPLWQHISFQALPPELREQTVHEVTTVGTAECRKWLSRSRTLGELESLNTVLSALLAVCNSAGEALDTGKQTAIIEVVSQLWAFLNIKQVADQPYVQQTFSLLLPLLGFFIQTLDPKLILQAVTLQTSLLKLELPDYVRLAMLDFVSSLGKLFIPEAIQDRILPNLSCMFALLLADRSWLLEQHTLEAFTQFAEGTNHEEIVPQCLSSEETKNKVVSFLEKTGFVDETEAAKVERVKQEKGIFWEPFANVTVEEAKRSSLQPYAKRARQEFPWEEEYRSALHTIAGALEATESLLQKGPAPAWLSMEMEALQERMDKLKRYIHTLG

SEQ ID NO: 798395 - protein, 933 aa, Homo sapiens
GTASFRSGLWRVWFEALLFDESMSQEGAVPASAVPLEELSSWPEELCRRELPSVLPRLLSLSQHSESWIEHIQILKIIVEMFLPHMNHLTLEQTFFSQVLPKTVKLFDDMMYELTSQARGLSSQNLEIQTTLRNILQTMVQLLGALTGCVQHICATQESIILENIQSLPSSVLHIIKSTFVHCKNSESVYSGCLHLVSDLLQALFKEAYSLQKQLMELLDMVCMDPLVDDNDDILNMVIVIHSLLDICSVISSMDHAFHANTWKFIIKQSLKHQSIIKSQLKHKDIITSLCEDILFSFHSCLQLAEQMTQSDAQDNADYRLFQKTLKLCRFFANSLLHYAKEFLPFLSDSCCTLHQLYLQIHSKFPPSLYATRISKAHQEEIAGAFLVTLDPLISQLLTFQPFMQVVLDSKLDLPCELQFPQCLLLVVVMDKLPSQPKEVQTLWCTDSQVSETTTRISLLKAVFYSFEQCSGELSLPVHLQGLKSKGKAEVAVTLYQHVCVHLCTFITSFHPSLFAELDAALLNAVLSANMITSLLAMDAWCFLARYGTAELCAHHVTIVAHLIKSCPGECYQLINLSILLKRLFFFMAPPHQLEFIQKFSPKEAENLPLWQHISFQALPPELREQTVHEVTTVGTAECRKWLSRSRTLGELESLNTVLSALLAVCNSAGEALDTGKQTAIIEVVSQLWAFLNIKQVADQPYVQQTFSLLLPLLGFFIQTLDPKLILQAVTLQTSLLKLELPDYVRLAMLDFVSSLGKLFIPEAIQDRILPNLSCMFALLLADRSWLLEQHTLEAFTQFAEGTNHEEIVPQCLSSEETKNKVVSFLEKTGFVDETEAAKVERVKQEKGIFWEPFANVTVEEAKRSSLQPYAKRARQEFPWEEEYRSALHTIAGALEATESLLQKGPAPAWLSMEMEALQERMDKLKRYIHTLG

SEQ ID NO: 798396 - protein, 718 aa, Homo sapiens; identical to SEQ ID NO: 798393

SEQ ID NO: 798397 - protein, 691 aa, Homo sapiens
MELLDMVCMDPLVDDNDDILNMVIVIHSLLDICSVISSMDHAFHANTWKFIIKQSLKHQSIIKSQLKHKDIITSLCEDILFSFHSCLQLAEQMTQSDAQDNADYRLFQKTLKLCRFFANSLLHYAKEFLPFLSDSCCTLHQLYLQIHSKFPPSLYATRISKAHQEEIAGAFLVTLDPLISQLLTFQPFMQVVLDSKLDLPCELQFPQCLLLVVVMDKLPSQPKEVQTLWCTDSQVSETTTRISLLKAVFYSFEQCSGELSLPVHLQGLKSKGKAEVAVTLYQHVCVHLCTFITSFHPSLFAELDAALLNAVLSANMITSLLAMDAWCFLARYGTAELCAHHVTIVAHLIKSCPGECYQLINLSILLKRLFFFMAPPHQLEFIQKFSPKEAENLPLWQHISFQALPPELREQTVHEVTTVGTAECRKWLSRSRTLGELESLNTVLSALLAVCNSAGEALDTGKQTAIIEVVSQLWAFLNIKQVADQPYVQQTFSLLLPLLGFFIQTLDPKLILQAVTLQTSLLKLELPDYVRLAMLDFVSSLGKLFIPEAIQDRILPNLSCMFALLLADRSWLLEQHTLEAFTQFAEGTNHEEIVPQCLSSEETKNKVVSFLEKTGFVDETEAAKVERVKQEKGIFWEPFANVTVEEAKRSSLQVWADFNRGQTLTRQILPFLLTDETNQCGFQPYAEFQIK

SEQ ID NO: 798398 - protein, 104 aa, Homo sapiens [sequence omitted]

SEQ ID NO: 798399 - protein, 202 aa, Homo sapiens
GTASFRSGLWRVWFEALLFDESMSQEGAVPASAVPLEELSSWPEELCRRELPSVLPRLLSLSQHSESWIEHIQILKIIVEMFLPHMNHLTLEQTFFSQVLPKTVKLFDDMMYELTSQARGLSSQNLEIQTTLRNILQTMVQLLGALTGCVQHICATQESIILENIQSLPSSVLHIIKSTFVHCKFQTFSRLFSRRPILFKSS

SEQ ID NO: 798400 - protein, 161 aa, Homo sapiens
MFLPHMNHLTLEQTFFSQVLPKTVKLFDDMMYELTSQARGLSSQNLEIQTTLRNILQTMVQLLGALTGCVQHICATQESIILENIQSLPSSVLHIIKSTFVHCKNSESVYSGCLHLVSDLLQALFKEAYSLQKQLMELLDMVCMDPLVDDNDDILNMVIGE

SEQ ID NO: 798401 - protein, 718 aa, Homo sapiens; identical to SEQ ID NO: 798393

SEQ ID NO: 798402 - protein, 718 aa, Homo sapiens; identical to SEQ ID NO: 798393

SEQ ID NO: 798403 - protein, 853 aa, Homo sapiens; identical to SEQ ID NO: 798394

SEQ ID NO: 798404 - protein, 718 aa, Homo sapiens; identical to SEQ ID NO: 798393

SEQ ID NO: 798405 - protein, 107 aa, Homo sapiens
MCRDQENSAWRNGGAGTLRVTPAGGVPKDNIHFGGTNGVVTQKMSTLGKERFCDREIRCNKCCDRKPPARRCWRKSQQNAGCCHRDTDFRTPASDGERRVRSHHITS

SEQ ID NO: 798406 - protein, 107 aa, Homo sapiens; identical to SEQ ID NO: 798405

SEQ ID NO: 798407 - protein, 107 aa, Homo sapiens; identical to SEQ ID NO: 798405

SEQ ID NO: 798408 - protein, 107 aa, Homo sapiens; identical to SEQ ID NO: 798405

SEQ ID NO: 798409 - protein, 107 aa, Homo sapiens; identical to SEQ ID NO: 798405

SEQ ID NO: 798410 - protein, 68 aa, Homo sapiens
RTPGRRGRAGTRPRDEGGRRLDTTCGRASEVLALRVDRLQVFTEHPRSLGQAQSEELGTGVAEDQALP

SEQ ID NO: 798411 - protein, 101 aa, Homo sapiens
DAFSPCCKAALGLLASSNLPTASSQSAGWNYRQTELLPNSLNYLDPNSQELLLRHFGEGQSKQYGSFLPGPWEKIIFLLEPVGKLQLSKITGPQVTSQQSL

SEQ ID NO: 798412 - protein, 98 aa, Homo sapiens
TPHRDLAPQAQEFGKGTREGSEGSVLVLSSPRLPGVKRGSGVGTRSLATVLPGIRSPPPPGCRVDKEEDVKRRQTKAKGHPVSRKRPNYNSDVQCLHK

SEQ ID NO: 798413 - protein, 89 aa, Homo sapiens
RRRSLCPTREGSEGSVLVLSSPRLPGVKRGSGVGTRSLATVLPGIRSPPPPGCRVDKEEDVKRRQTKAKGHPVSRKRPNYNSDVQCLHK

SEQ ID NO: 798414 - protein, 146 aa, Homo sapiens
MEAADYSRKAFFLPCLPHCPTWGNNPYYICSDLPLCPGLTHAYPSQPRAWHPVHWELMFLGLQVSTSPPSPSDPRAYLAVTTQVIPIVQPLALGEGELVPPLHEVAQPRVHLAIIDATYRRKEENKERLFCPEPSPERIHTYYVPT

SEQ ID NO: 798415 - protein, 157 aa, Homo sapiens
AVGRRRSPPAAVRAGSRLGAGVVRVPLAVAARRLVREAGAGAVTGPCPAAAQGARGSWPSPRCLPSDGGAREAPPTSAPHPRRPAGSPPALADREGRRSLVPQTSIQGQNFAQLSLARPWAGKRGHRQREPEALRALRAGQELWNLSDDILILLDQD

SEQ ID NO: 798416 - protein, 123 aa, Homo sapiens
MAGENYRPGPPAGPLFNGKPHQDRLDPSDAQFVDVIHSDTDALGYKEPLGNIDFYPNGGLDQPGCPKTILGGFQYFKCDHQRSVYLYLSSLRESCTITAYPCDSYQDYWNGKCVSLRVTKRVL

SEQ ID NO: 798417 - protein, 495 aa, Homo sapiens
GQTWARRALLLGILWATAHLPLSGTSLPQRLPRATGNSTQCVISPSSEFPEGFFTRQERRDGGIIIYFLIIVYMFMAISIVCDEYFLPSLEIISESLGLSQDVAGTTFMAAGSSAPELVTAFLGVFITKGDIGISTILGSAIYNLLGICAACGLLSNTVSTLSCWPLFRDCAAYTISAAAVLGIIYDNQVYWYEGALLLLIYGLYVLVLCFDIKINQYIIKKCSPCCACLAKAMERSEQQPLMGWEDEGQPFIRRQSRTDSGIFYEDSGYSQLSISLHGLSQVSEDPPSVFNMPEADLKRIFWVLSLPIITLLFLTTPDCRKKFWKNYFVITFFMSAIWISAFTYILVWMVTITGETLEIPDTVMGLTLLAAGTSIPDTIASVLVARKGKGDMAMSNIVGSNVFDMLCLGIPWFIKTAFINGSAPAEVNSRGLTYITISLNISIIFLFLAVHFNGWKLDRKLGIVCLLSYLGLATLSVLYELGIIGNNKIRGCGG

SEQ ID NO: 798418 - protein, 69 aa, Homo sapiens
LVRQKSSPSPHSTQEVQLASPLTGITVTEAEKSKIKGPHPVRAFLLMVDWKQCQHDSPTWKDKMGLIIR

SEQ ID NO: 798419 - protein, 185 aa, Homo sapiens
MRNDSLNFSTATQSVDTHQRSFDIGIQIGYQRRNKDVLAWVKKRRRTIRREDLISFLCGKVPPPRNSRAPPRLTVVSPNRATSTETSSSVETDLQPFREAIALHGLSGAMASISVRSSTPGSPTHVSSGSNASRRRNGLHDVDLNTFISEEMALHLDNGGTRKRTSAQCGDVITDSPTHKRNRMI

SEQ ID NO: 798420 - protein, 515 aa, Homo sapiens
PLGSDATTVSSSPSSSFILPDIHSLPPANWLRQADRPKNQSRRCAQKPPRGTGRIRLIGALGAATPQPGRVAWAQWAVLLLSACGRGRAGTSSRRAVLGGGDDDDVAQSWGGLRGAGRAARRARRSAAAAAVGRPQRHGGALDRLRRPRRGAAAVIWSAATFGRARGWEGLGRGSSLVARGRGAGLAGRRGAGGLGLLKGEGAVGRQALPPGRLTTTLPRGPRLRRTRRRWRRGRGRPRRMEERKEEGEAEIQEHGPEHWFSKWERQCLAEAEQDEQLPPELQEEAAAAAQPEHKQQKLWHLFQNSATAVAQLYKDRVCQQPGLSLWVPFQNAATAVTNLYKESVDTHQRSFDIGIQIGYQRRNKDVLAWVKKRRRTIRREDLISFLCGKVPPPRNSRAPPRLTVVSPNRATSTETSSSVETDLQPFREAIALHGLSGAMASISVRSSTPGSPTHVSSGSNASRRRNGLHDVDLNTFISEEMALHLDNGGTRKRTSAQCGDVITDSPTHKRNRMI

SEQ ID NO: 798421 - protein, 438 aa, Homo sapiens
PLGSDATTVSSSPSSSFILPDIHSLPPANWLRQADRPKNQSRRCAQKPPRGTGRIRLIGALGAATPQPGRVAWAQWAVLLLSACGRGRAGTSSRRAVLGGGDDDDVAQSWGGLRGAGRAARRARRSAAAAAVGRPQRHGGALDRLRRPRRGAAAVIWSAATFGRARGWEGLGRGSSLVARGRGAGLAGRRGAGGLGLLKGEGAVGRQALPPGRLTTTLPRGPRLRRTRRRWRRGRGRPRRMEERKEEGEAEIQEHGPEHWFSKWERQCLAEAEQDEQLPPELQEEAAAAAQPEHKQQKLWHLFQNSATAVAQLYKDRVCQQPGLSLWVPFQNAATAVTNLYKESVDTHQRSFDIGIQIGYQRRNKDVLAWVKKRRRTIRREDLISFLCGKVPPPRNSRAPPRLTVVSPNRATSTETSSSVETDLQPFREAIALHGKAV

SEQ ID NO: 798422 - protein, 109 aa, Homo sapiens
MNGLIQGVKGLLSFLSAPLIGALSDVWGRKSFLLLTVFFTCAPIPLMKISPWWYFAVISVSGVFAVTFSVVFAYVADITQEHERSMAYGLVCMFILYLLYLLRNALFLR

SEQ ID NO: 798423 - protein, 432 aa, Homo sapiens
LLVLHETFPKHTFLMNGLIQGVKGLLSFLSAPLIGALSDVWGRKSFLLLTVFFTCAPIPLMKISPWWYFAVISVSGVFAVTFSVVFAYVADITQEHERSMAYGLVSATFAASLVTSPAIGAYLGRVYGDSLVVVLATAIALLDICFILVAVPESLPEKMRPASWGAPISWEQADPFASLKKVGQDSIVLLICITVFLSYLPEAGQYSSFFLYLRQIMKFSPESVAAFIAVLGILSIIAQTIVLSLLMRSIGNKNTILLGLGFQILQLAWYGFGSEPWMMWAAGAVAAMSSITFPAVSALVSRTADADQQGVVQGMITGIRGLCNGLGPALYGFIFYIFHVELKELPITGTDLGTNTSPQHHFEQNSIIPGPPFLFGACSVLLALLVALFIPEHTNLSLRSSSWRKHCGSHSHPHNTQAPGEAKEPLLQDTNV

SEQ ID NO: 798424 - protein, 380 aa, Homo sapiens
MNGLIQGVKGLLSFLSAPLIGALSDVWGRKSFLLLTVFFTCAPIPLMKISPWWYFAVISVSGVFAVTFSVVFAYVADITQEHERSMAYGLVSATFAASLVTSPAIGAYLGRVYGDSLVVVLATAIALLDICFILVAVPESLPEKMRPASWGAPISWEQADPFAIMKFSPESVAAFIAVLGILSIIAQTIVLSLLMRSIGNKNTILLGLGFQILQLAWYGFGSEPWMMWAAGAVAAMSSITFPAVSALVSRTADADQQGVVQGMITGIRGLCNGLGPALYGFIFYIFHVELKELPITGTDLGTNTSPQHHFEQNSIIPGPPFLFGACSVLLALLVALFIPEHTNLSLRSSSWRKHCGSHSHPHNTQAPGEAKEPLLQDTNV

SEQ ID NO: 798425 - protein, 432 aa, Homo sapiens; identical to SEQ ID NO: 798423

SEQ ID NO: 798426 - protein, 103 aa, Homo sapiens
FLFCCSPYRMMWAAGAVAAMSSITFPAVSALVSRTADADQQGVVQGMITGIRGLCNGLGPALYGFIFYIFHVELKELPITGTDLGTNTSPQHHFEQLSQDIDL

SEQ ID NO: 798427 - protein, 274 aa, Homo sapiens
MRPASWGAPISWEQADPFASLKKVGQDSIVLLICITVFLSYLPEAGQYSSFFLYLRQIMKFSPESVAAFIAVLGILSIIAQTIVLSLLMRSIGNKNTILLGLGFQILQLAWYGFGSEPWMMWAAGAVAAMSSITFPAVSALVSRTADADQQGVVQGMITGIRGLCNGLGPALYGFIFYIFHVELKELPITGTDLGTNTSPQHHFEQNSIIPGPPFLFGACSVLLALLVALFIPEHTNLSLRSSSWRKHCGSHSHPHNTQAPGEAKEPLLQDTNV

SEQ ID NO: 798428 - protein, 432 aa, Homo sapiens; identical to SEQ ID NO: 798423

SEQ ID NO: 798429 - protein, 101 aa, Homo sapiens
GFRAPPEARPAPNKSGATSLRLSRTLLGAARQGETFAAERSGENAPATPSRPRPSPTYHRRRPPWRLGRPAGNPGRSRQSGLDPRWPAGSDGETDMKRSPK

SEQ ID NO: 798430 - protein, 106 aa, Homo sapiens
ADIKSICAEAALCALRRRYPQIYTTSEKLQLDLSSINISAKDFEVAMQKMIPASQRAVTSPGQALSTVVKPLLQNTVDKILEALQRVFPHAEFRTNKTLDSGIKLD

SEQ ID NO: 798431 - protein, 403 aa, Homo sapiens
ADIKSICAEAALCALRRRYPQIYTTSEKLQLDLSSINISAKDFEVAMQKMIPASQRAVTSPGQALSTVVKPLLQNTVDKILEALQRVFPHAEFRTNKTLDSDISCPLLESDLAYSDDDVPSVYENGLSQKSSHKAKDNFNFLHLNRNACYQPMSFRPRILIVGEPGFGQGSHLAPAVIHALEKFTVYTLDIPVLFGVSTTSPEETCAQVIREAKRTAPSIVYVPHIHVWWEIVGPTLKATFTTLLQNIPSFAPVLLLATSDKPHSALPEEVQELFIRDYGEIFNVQLPDKEERTKFFEDLILKQAAKPPISKKKAVLQALEVLPVAPPPEPRSLTAEEVKRLEEQEEDTFRELRIFLRNVTHRLAIDKRFRVFTKPVDPDEVPDYVTVIKQPMDLSSVIRSNL

SEQ ID NO: 798432 - protein, 532 aa, Homo sapiens
ADIKSICAEAALCALRRRYPQIYTTSEKLQLDLSSINISAKDFEVAMQKMIPASQRAVTSPGQALSTVVKPLLQNTVDKILEALQRVFPHAEFRTNKTLDSDISCPLLESDLAYSDDDVPSVYENGLSQKSSHKAKDNFNFLHLNRNACYQPMSFRPRILIVGEPGFGQGSHLAPAVIHALEKFTVYTLDIPVLFGVSTTSPEETCAQVIREAKRTAPSIVYVPHIHVWWEIVGPTLKATFTTLLQNIPSFAPVLLLATSDKPHSALPEEVQELFIRDYGEIFNVQLPDKEERTKFFEDLILKQAAKPPISKKKAVLQALEVLPVAPPPEPRSLTAEEVKRLEEQEEDTFRELRIFLRNVTHRLAIDKRFRVFTKPVDPDEVPDYVTVIKQPMDLSSVISKIDLHKYLTVKDYLRDIDLICSNALEYNPDRDPGDRLIRHRACALRDTAYAIIKEELDEDFEQLCEEIQESRKKRGCSSSKYAPSYYHVMPKQNSTLVGDKRSDPEQNEKLKTPSTPVACSTPGKYSSSFHL

SEQ ID NO: 798433 - protein, 642 aa, Homo sapiens
PSHHWQLGQKLEGLLRQVGEVCRQDIQDFTQATLDTARSLCPQMLQGSSWREQLEGVLAGSRGLPELLPEQLLQDAFTRLRDMRLSITGTLAESIVAQALAGLSAARDQLVESLAQQATVTMPPALPAPDGGEPSLLEPGELEGLFFPEEKEEEKEKDDSPPQKWPELSHGLHLVPFIHSAAEEAEPEPELAAPGEDAEPQAGPSARGSPSPAAPGPPAGPLPRMDLPLAGQPLRHPTRARPRPRRQHHHRPPPGGPQVPPALPQEGNGLSARVDEGVEEFFSKRLIQQDRLWAPEEDPATEGGATPVPRTLRKKLGTLFAFKKPRSTRGPRTDLETSPGAAPRTRKTTFGDLLRPPTRPSRGEELGGAEGDTSSPDPAGRSRPRYTRDSKAYSMILLPAEEEATLGARPDKRRPLERGETELAPSFEQRVQVMLQRIGVSRGSGGAEGKRKQSKDGEIKKAGSDGDIMDSSTEAPPISIKSRTHSVSADPSCRPGPGSQGPESATWKTLGQQLNAELRSRGWGQQDGPGPPSPGQSPSPCRTSPSPDSLGLPEDPCLGPRNEGRRAVSVHEDQLQAPAERPLRLQRSPVLKRRPKLEAPPSPSLGSGLGTEPLPPQPTEPSSPERSPPSPATDQRGGGPNP

SEQ ID NO: 798434 - protein, 653 aa, Homo sapiens
PSHHWQLGQKLEGLLRQVGEVCRQDIQDFTQATLDTARSLCPQMLQGSSWREQLEGVLAGSRGLPELLPEQLLQDAFTRLRDMRLSITGTLAESIVAQALAGLSAARDQLVESLAQQATVTMPPALPAPDGGEPSLLEPGELEGLFFPEEKEEEKEKDDSPPQKWPELSHGLHLVPFIHSAAEEAEPEPELAAPGEDAEPQAGPSARGSPSPAAPGPPAGPLPRMDLPLAGQPLRHPTRARPRPRRQHHHRPPPGGPQVPPALPQEGNGLSARVDEGVEEFFSKRLIQQDRLWAPEEDPATEGGATPVPRTLRKKLGTLFAFKKPRSTRGPRTDLETSPGAAPRTRKTTFGDLLRPPTRPSRGEELGGAEGDTSSPDPAGRSRPRYTRDSKAYSMILLPAEEEATLGARPDKRRPLERGETELAPSFEQRVQVMLQRIGVSRGSGGAEGKRKQSKDGEIKKAGSDGDIMDSSTEAPPISIKSRTHSVSADPSCRPGPGSQGPESATWKTLGQQLNAELRSRGWGQQDGPGPPSPGQSPSPCRTSPSPDSLGLPEDPCLGPRNEDGQLRPRPLSAGRRAVSVHEDQLQAPAERPLRLQRSPVLKRRPKLEAPPSPSLGSGLGTEPLPPQPTEPSSPERSPPSPATDQRGGGPNP

SEQ ID NO: 798435 - protein, 670 aa, Homo sapiens
PSHHWQLGQKLEGLLRQVGEVCRQDIQDFTQATLDTARSLCPQMLQGSSWREQLEGVLAGSRGLPELLPEQLLQDAFTRLRDMRLSITGTLAESIVAQALAGLSAARDQLVESLAQQATVTMPPALPAPDGGEPSLLEPGELEGLFFPEEKEEEKEKDDSPPQKWPELSHGLHLVPFIHSAAEEAEPEPELAAPGEDAEPQAGPSARGSPSPAAPGPPAGPLPRMDLPLAGQPLRHPTRARPRPRRQHHHRPPPGGPQVPPALPQEGNGLSARVDEGVEEFFSKRLIQQDRLWAPEEDPATEGGATPVPRTLRKKLGTLFAFKKPRSTRGPRTDLETSPGAAPRTRKTTFGDLLRPPTRPSRGEELGGAEGDTSSPDPAGRSRPRYTRDSKAYSMILLPAEEEATLGARPDKRRPLERGETELAPSFEQRVQVMLQRIGVSRGSGGAEGKRKQSKDGEIKKAGSDGLVPESPAPPCGDIMDSSTEAPPISIKSRTHSVSADPSCRPGPGSQGPESATWKTLGQQLNAELRSRGWGQQDGPGPPSPGQSPSPCRTSPSPDSLGLPEDPCLGPRNEGRRAVSVHEDQLQAPAGEGRHLHVCLNAGDVGGWASGAPFIALVLGGSHQCVRSQEIREPEDQVQGFDSKPFQLALAPLPEEQPLPGVRTQGRGML

SEQ ID NO: 798436 - protein, 105 aa, Homo sapiens
MFLSSPWWAFSGRIIRTRTNKRLGCGERAGLESDCPVSCRAKMARSRKLAQMVSGTLGCGSTFARRCPYRQPPRHLLSLGRKGRGQVFLPLTSKVWYLSPQLRLA

SEQ ID NO: 798437 - protein, 659 aa, Homo sapiens
PSHHWQLGQKLEGLLRQVGEVCRQDIQDFTQATLDTARSLCPQMLQGSSWREQLEGVLAGSRGLPELLPEQLLQDAFTRLRDMRLSITGTLAESIVAQALAGLSAARDQLVESLAQQATVTMPPALPAPDGGEPSLLEPGELEGLFFPEEKEEEKEKDDSPPQKWPELSHGLHLVPFIHSAAEEAEPEPELAAPGEDAEPQAGPSARGSPSPAAPGPPAGPLPRMDLPLAGQPLRHPTRARPRPRRQHHHRPPPGGPQVPPALPQEGNGLSARVDEGVEEFFSKRLIQQDRLWAPEEDPATEGGATPVPRTLRKKLGTLFAFKKPRSTRGPRTDLETSPGAAPRTRKTTFGDLLRPPTRPSRGEELGGAEGDTSSPDPAGRSRPRYTRDSKAYSMILLPAEEEATLGARPDKRRPLERGETELAPSFEQRVQVMLQRIGVSRGSGGAEGKRKQSKDGEIKKAGSDGDIMDSSTEAPPISIKSRTHSVSADPSCRPGPGSQGPESATWKTLGQQLNAELRSRGWGQQDGPGPPSPGQSPSPCRTSPSPDSLGLPEDPCLGPRNEGRRAVSVHEDQLQAPAGEGRHLHVCLNAGDVGGWASGAPFIALVLGGSHQCVRSQEIREPEDQVQGFDSKPFQLALAPLPEEQPLPGVRTQGRGML

SEQ ID NO: 798438 - protein, 626 aa, Homo sapiens
PSHHWQLGQKLEGLLRQVGEVCRQDIQDFTQATLDTARSLCPQMLQGSSWREQLEGVLAGSRGLPELLPEQLLQDAFTRLRDMRLSITGTLAESIVAQALAGLSAARDQLVESLAQQATVTMPPALPAPDGGEPSLLEPGELEGLFFPEEKEEEKEKDDSPPQKWPELSHGLHLVPFIHSAAEEAEPEPELAAPGEDAEPQAGPSARGSPSPAAPGPPAGPLPRMDLPLAGQPLRHPTRARPRPRRQHHHRPPPGGPQVPPALPQEGNGLSARVDEGVEEFFSKRLIQQDRLWAPEEDPATEGGATPVPRTLRKKLGTLFAFKKPRSTRGPRTDLETSPGAAPRTRKTTFGDLLRPPTRPSRGEELGGAEGDTSSPDPAGRSRPRYTRDSKAYSMILLPAEEEATLGARPDKRRPLERGETELAPSFEQRVQVMLQRIGVSRGSGGAEGKRKQSKDGEIKKAGSDGDIMDSSTEAPPISIKSRTHSVSADPSCRPGPGSQGPESATWKTLGQQLNAELRSRGWGQQDGPGPPSPGQSPSPCRTSPSPDSLGLPEDPCLGPRNEERPLRLQRSPVLKRRPKLEAPPSPSLGSGLGTEPLPPQPTEPSSPERSPPSPATDQRGGGPNP

SEQ ID NO: 798439 - protein, 564 aa, Homo sapiens
MAEALPAIFGCLVLQVESLAQQATVTMPPALPAPDGGEPSLLEPGELEGLFFPEEKEEEKEKDDSPPQKWPELSHGLHLVPFIHSAAEEAEPEPELAAPGEDAEPQAGPSARGSPSPAAPGPPAGPLPRMDLPLAGQPLRHPTRARPRPRRQHHHRPPPGGPQVPPALPQEGNGLSARVDEGVEEFFSKRLIQQDRLWAPEEDPATEGGATPVPRTLRKKLGTLFAFKKPRSTRGPRTDLETSPGAAPRTRKTTFGDLLRPPTRPSRGEELGGAEGDTSSPDPAGRSRPRYTRDSKAYSMILLPAEEEATLGARPDKRRPLERGETELAPSFEQRVQVMLQRIGVSRGSGGAEGKRKQSKDGEIKKAGSDGDIMDSSTEAPPISIKSRTHSVSADPSCRPGPGSQGPESATWKTLGQQLNAELRSRGWGQQDGPGPPSPGQSPSPCRTSPSPDSLGLPEDPCLGPRNEGRRAVSVHEDQLQAPAGEGRHLHVCLNAGDVGGWASGAPFIALVLGGSHQCVRSQEIREPEDQVQGFDSKPFQLALAPLPEEQPLPGVRTQGRGML

SEQ ID NO: 798440 - protein, 82 aa, Homo sapiens
AATSPGSALGALLVLSPQVLLRKRSRSPSWRLREKMQSRRRGRPRAALRALPPLGPRPARCPAWTCHWRGSPCAIRPGPGRG

SEQ ID NO: 798441 - protein, 466 aa, Homo sapiens
AATAAARAVTAAAAAAPGGRWCRVPRRPVRRWGAAGRGEPTAAAAPEERSRARERRGRAGPAAEERGGARQAARGPRAKQRRPRRKRGRRPGFLRPPLLSSQYFLFGLSFASPQLPPYPHTPTPPFPRSKLPSAPGGLPRPGTPCASPPGLRGSPSETMRKFNIRKVLDGLTAGSSSASQQQQQQHPPGNREPEIQETLQSEHFQLCKTVRHGFPYQPSALAFDPVQKILAVGTQTGALRLFGRPGVECYCQHDSGAAVIQLQFLINEGALVSALADDTLHLWNLRQKRPAILHSLKFCRERVTFCHLPFQSKWLYVGTERGNIHIVNVESFTLSGYVIMWNKAIELSSKSHPGPVVHISDNPMDEGKLLIGFESGTVVLWDLKSKKADYRYTYDEAIHSVAWHHEGKQFICSHSDGTLTIWNVRSPAKPVQTITPHGKQLKDGKKPEPCKPILKVEFKTTRSGVC

SEQ ID NO: 798442 - protein, 396 aa, Homo sapiens
AATAAARAVTAAAAAAPGGRWCRVPRRPVRRWGAAGRGEPTAAAAPEERSRARERRGRAGPAAEERGGARQAARGPRAKQRRPRRKRGRRPGFLRPPLLSSQYFLFGLSFASPQLPPYPHTPTPPFPRSKLPSAPGGLPRPGTPCASPPGLRGSPSETMRKFNIRKVLDGLTAGSSSASQQQQQQHPPGNREPEIQETLQSEHFQLCKTVRHGFPYQPSALAFDPVQKILAVGTQTGALRLFGRPGVECYCQHDSGAAVIQLQFLINEGALVSALADDTLHLWNLRQKRPAILHSLKFCRERVTFCHLPFQSKWLYVGTERGNIHIVNVESFTLSGYVIMWNKAIELSSKSHPGPVVHISDNPMDEGKVEFFVKNYILNAQILVFFNKHAISGSHL

SEQ ID NO: 798443 - protein, 557 aa, Homo sapiens
AATAAARAVTAAAAAAPGGRWCRVPRRPVRRWGAAGRGEPTAAAAPEERSRARERRGRAGPAAEERGGARQAARGPRAKQRRPRRKRGRRPGFLRPPLLSSQYFLFGLSFASPQLPPYPHTPTPPFPRSKLPSAPGGLPRPGTPCASPPGLRGSPSETMRKFNIRKVLDGLTAGSSSASQQQQQQHPPGNREPEIQETLQSEHFQLCKTVRHGFPYQPSALAFDPVQKILAVGTQTGALRLFGRPGVECYCQHDSGAAVIQLQFLINEGALVSALADDTLHLWNLRQKRPAILHSLKFCRERVTFCHLPFQSKWLYVGTERGNIHIVNVESFTLSGYVIMWNKAIELSSKSHPGPVVHISDNPMDEGKLLIGFESGTVVLWDLKSKKADYRYTYDEAIHSVAWHHEGKQFICSHSDGTLTIWNVRSPAKPVQTITPHGKQLKDGKKPEPCKPILKVEFKTTRSGEPFIILSGGLSYDTVGRRPCLTVMHGKSTAVLEMDYSIVDFLTLCETPYPNDFQEPYAVVVLLEKDLVLIDLAQNGYPIFENPYPLSIHESPV

SEQ ID NO: 798444 - protein, 268 aa, Homo sapiens
AATAAARAVTAAAAAAPGGRWCRVPRRPVRRWGAAGRGEPTAAAAPEERSRARERRGRAGPAAEERGGARQAARGPRAKQRRPRRKRGRRPGFLRPPLLSSQYFLFGLSFASPQLPPYPHTPTPPFPRSKLPSAPGGLPRPGTPCASPPGLRGSPSETMRKFNIRKVLDGLTAGSSSASQQQQQQHPPGNREPEIQETLQSEHFQLCKVNGARSPATPSLKNWGCFKGATRALHGNAREENANNNNNNSNKRLAPPLANVSSVGCFGD

SEQ ID NO: 798445 - protein, 474 aa, Homo sapiens
MTAGSPEECGEVRRSPEGRVSRLGRRLGRRRRPRSPPEPLRVRARLRLRSPSGAFAALGALVVLVGMGIAVAGYWPHRAGAPGSRAANASSPQMSELRREGRGGGRAHGPHERLRLLGPVIMGVGLFVFICANTLLYENRDLETRRLRQGVLRAQALRPPDGPGWDCALLPSPGPRSPRAVGCAEPEIWDPSPRRGTSPVPSVRSLRSEPANPRLGLPALLNSYPLKGPGLPPPWGPRTQTGHVIITVQPSGSCIEHSKSLDLGLGELLLGAPAARDCAHRSWPRLDRLSLGGYAKLGGGGDLGARVLKRGETACSEAAAWTMLIGPKDQESQRLIDVSVTSQAGDGCSDHSSCEGHPDLHAGREMPAAPGLSELERVRFTVGCGGLASGISSASVSGLSPNRAGGPGQGDWEMYPVSWQTQESGGQGPLRLGGRLGCYRLGQAPSKAALVMECGASGKMDHGMRLSTAIWDGD

SEQ ID NO: 798446 - protein, 474 aa, Homo sapiens; identical to SEQ ID NO: 798445

SEQ ID NO: 798447 - protein, 474 aa, Homo sapiens; identical to SEQ ID NO: 798445

SEQ ID NO: 798448 - protein, 715 aa, Homo sapiens
IPAGSRGWDGNAGWKSGRGKSLKTLMSKGILQVHPPICDCPGCRISSPVNRGRLADKRTVALPAARNLKKEELPSFSAPPTRDRTGVAPPVGGWPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQEALLLPRELGPSMAPEDHYRRLVSALSEASTFEDPQRLYHLGLPSHDLLRVRQEVAAAALRGPSGLEAHLPSSTAGQRRKQGLAQHREGAAPAAAPSFSERELPQPPPLLSPQNAPHVALGPHLRPPFLGVPSALCQTPGYGFLPPAQAEMFARQQELLRKQNLGPAGAARRLLRQKELESARPQLLAPRPPWPQRRPEELQRPRALLVLNHGAGTAGPAPQAPGLRTPEPVPDLCPSSPPEGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQALQVARRLGRVFYVASFPVALPLQPPTLRAPERELGTGEQPLSPTTATCPYRRRGPRPCRSNFTQAGEWDLGSTSRGPRPFPASVSRLPGVGVGPHKSPGATTQHNGP

SEQ ID NO: 798449 - protein, 731 aa, Homo sapiens
IPAGSRGWDGNAGWKSGRGKSLKTLMSKGILQVHPPICDCPGCRISSPVNRGRLADKRTVALPAARNLKKEELPSFSAPPTRDRTGVAPPVGGWPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQEALLLPRELGPSMAPEDHYRRLVSALSEASTFEDPQRLYHLGLPSHGEDPPWHDPPHHLPSHDLLRVRQEVAAAALRGPSGLEAHLPSSTAGQRRKQGLAQHREGAAPAAAPSFSERELPQPPPLLSPQNAPHVALGPHLRPPFLGVPSALCQTPGYGFLPPAQAEMFARQQELLRKQNLGPAGAARRLLRQKELESARPQLLAPRPPWPQRRPEELQRPRALLVLNHGAGTAGPAPQAPGLRTPEPVPDLCPSSPPEGRPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQALQVARRLGRVFYVASFPVALPLQPPTLRAPERELGTGEQPLSPTTATCPYRRRGPRPCRSNFTQAGEWDLGSTSRGPRPFPASVSRLPGVGVGPHKSPGATTQHNGP

SEQ ID NO: 798450 - protein, 520 aa, Homo sapiens
MAPEDHYRRLVSALSEASTFEDPQRLYHLGLPSHGEDPPWHDPPHHLPSHDLLRVRQEVAAAALRGPSGLEAHLPSSTAGQRRKQGLAQHREGAAPAAAPSFSERELPQPPPLLSPQNAPHVALGPHLRPPFLGVPSALCQTPGYGFLPPAQAEMFARQQELLRKQNLGPAGAARRLLRQKELESARPQLLAPRPPWPQRRPEELQRPRALLVLNHGAGTAGPAPQAPGLRTPEPVPDLCPGAPRKGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQALQVARRLGRVFYVASFPVALPLQPPTLRAPERELGTGEQPLSPTTATCPYRRRGPRPCRSNFTQAGEWDLGSTSRGPRPFPASVSRLPGVGVGPHKSPGATTQHNGP

SEQ ID NO: 798451 - protein, 511 aa, Homo sapiens
RNPAASAGALGPAGIDAGGLAGWALRAGTRPGAGPTSAFGHDLLRVRQEVAAAALRGPSGLEAHLPSSTAGQRRKQGLAQHREGAAPAAAPSFSERELPQPPPLLSPQNAPHVALGPHLRPPFLGVPSALCQTPGYGFLPPAQAEMFARQQELLRKQNLGPAGAARRLLRQKELESARPQLLAPRPPWPQRRPEELQRPRALLVLNHGAGTAGPAPQAPGLRTPEPVPDLCPSSPPEGGPGPASARPSESKEMTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQALQVARRLGRVFYVASFPVALPLQPPTLRAPERELGTGEQPLSPTTATCPYRRRGPRPCRSNFTQAGEWDLGSTSRGPRPFPASVSRLPGVGVGPHKSPGATTQHNGP

SEQ ID NO: 798452 - protein, 540 aa, Homo sapiens
IPAGSRGWDGNAGWKSGRGKSLKTLMSKGILQVHPPICDCPGCRISSPVNRGRLADKRTVALPAARNLKKEELPSFSAPPTRDRTGVAPPVGGWPGLKQEDGPHIRIMKRRVHTHWDVNISFREASCSQDGNLPTLISSVHRSRHLVMPEHQSRCEFQRGSLEIGLRPAGDLLGKRLGRSPRISSDCFSEKRARSESPQEALLLPRELGPSMAPEDHYRRLVSALSEASTFEDPQRLYHLGLPSHDLLRVRQEVAAAALRGPSGLEAHLPSSTAGQRRKQGLAQHREGAAPAAAPSFSERELPQPPPLLSPQNAPPLRAKLQLEEAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQALQVARRLGRVFYVASFPVALPLQPPTLRAPERELGTGEQPLSPTTATCPYRRRGPRPCRSNFTQAGEWDLGSTSRGPRPFPASVSRLPGVGVGPHKSPGATTQHNGP

SEQ ID NO: 798453 - protein, 259 aa, Homo sapiens
MTGARLWAQDGSEDEPPKDSDGEDPETAAVGCRGPTPGQAPAGGAGAEGKGLFPGSTLPLGFPYAVSPYFHTGAVGGLSMDGEEAPAPEDVTKWTVDDVCSFVGGLSGCGEYTRVFREQGIDGETLPLLTEEHLLTNMGLKLGPALKIRAQALQVARRLGRVFYVASFPVALPLQPPTLRAPERELGTGEQPLSPTTATCPYRRRGPRPCRSNFTQAGEWDLGSTSRGPRPFPASVSRLPGVGVGPHKSPGATTQHNGP

SEQ ID NO: 798454 - protein, 83 aa, Homo sapiens
FCLTLKPNRSLFLKNFRELHKQLLLALLGWRMEQHPGPDPPSLPLPGLQGAGDRRGDPATADGGAPADQHGAEAGARPQDPGP

SEQ ID NO: 798455 - protein, 458 aa, Homo sapiens
RSCAPPTMRRLPRALLLQLRLALLVAAGAPEVLVSAPRSLVWGPGLQAAVVLPVRYFYLQAVNSEGQNLTRSPAGETPFKVVVKSLSPKELVRIHVPKPLDRNDGTFLMRYRMYETVDEGLKIEVLYGDEHVAQSPYILKGPVYHEYCECPEDPQAWQKTLSCPTKEPQIAKDFASFPSINLQQMLKEVPKRFGDERGAIVHYTILNNHVYRRSLGKYTDFKMFSDEILLSLTRKVLLPDLEFYVNLGDWPLEHRKVNGTPSPIPIISWCGSLDSRDVVLPTYDITHSMLEAMRGVTNDLLSIQGNTGPSWINKTERAFFRGRDSREERLQLVQLSKENPQLLDAGITGYFFFQEKEKELGKAKLMGFFDFFKYKYQVNVDGTVAAYRYPYLMLGDSLVLKQDSPYYEHFYMALEPWKHYVPIKRNLSDLLEKVKWAKENDEEAKKIAKEGQLMARDL

SEQ ID NO: 798456 - protein, 79 aa, Homo sapiens
MTTTRARYHIYPYLMLGDSLVLKQDSPYYEHFYMALEPWKHYVPIKRNLSDLLEKVKWAKENDEEAKKIAKEGQLMARD

SEQ ID NO: 798457 - protein, 101 aa, Homo sapiens
TSSLTFYSKSEMHIHSKSHTETKPHKCPHCSKTFANSSYLAQHIRIHSGAKPYSCNFVGGFVLSVKLQNRGVAEKGEFKANARTGLSSLGATVRCRTRIYI

SEQ ID NO: 798458 - protein, 105 aa, Homo sapiens
VAQAEAQAQAQAQAQAQAQAQAQASQASQQQQQQQQQQQQQQQQPPPHFQSPGAAPQGGGGGDSNPNPPPQCSFDLTPYKTAEHHKDICLTVTTSTIQVEHLASS

SEQ ID NO: 798459 - protein, 105 aa, Homo sapiens; identical to SEQ ID NO: 798458

SEQ ID NO: 798460 - protein, 105 aa, Homo sapiens; identical to SEQ ID NO: 798458

SEQ ID NO: 798461 - protein, 105 aa, Homo sapiens; identical to SEQ ID NO: 798458

SEQ ID NO: 798462 - protein, 105 aa, Homo sapiens; identical to SEQ ID NO: 798458

SEQ ID NO: 798463 - protein, 129 aa, Homo sapiens
RLVREWISSTRPSGDSNPNPPPQCSFDLTPYKTAGIIRTSASLSPPAPSRWSTWPALRDPCCHPLGRGRSSPGVFFLQLLVGKVLFFLDRPWLHLLGPLSRLSFTGYHPFSELFFKRNISPPDCKGILS

SEQ ID NO: 798464 - protein, 105 aa, Homo sapiens; identical to SEQ ID NO: 798458

SEQ ID NO: 798465 - protein, 424 aa, Homo sapiens
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRSECPRKDNCTAKEWTFPEAKWNTTARVFSHIRLGMGHVLIIVQCFISSMANIYNEKILKEGNQLTESIFIQNSKLYFFGILFNGLTLGLQRSNRDQIKNCGFFYGHSAFSVALIFVTAFQGLSVAFILKFLDNMFHVLMAQVTTVIITTVSVLVFDFRPSLEFFLEAPSVLLSIFIYNASKPQVPEYAPRQERIRDLSGNLWERSSGDGEELERLTKPKSDESDEDTF

SEQ ID NO: 798466 - protein, 424 aa, Homo sapiens; identical to SEQ ID NO: 798465

SEQ ID NO: 798467 - protein, 424 aa, Homo sapiens; identical to SEQ ID NO: 798465

SEQ ID NO: 798468 - protein, 330 aa, Homo sapiens [sequence omitted]

SEQ ID NO: 798469 - protein, 424 aa, Homo sapiens; identical to SEQ ID NO: 798465

SEQ ID NO: 798470 - protein, 235 aa, Homo sapiens
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRSPPWNFSWKPHQSFSLYLFIMPASLKFRNTHLGKKGSEI

SEQ ID NO: 798471 - protein, 209 aa, Homo sapiens
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRRWRRTRKTYQTQE

SEQ ID NO: 798472 - protein, 119 aa, Homo sapiens
MKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRTSLKFRNTHLGKKGSEI

SEQ ID NO: 798473 - protein, 403 aa, Homo sapiens
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRSECPRKDNCTAKEWTFPEAKWNTTARVFSHIRLGMGHVLIIVQCFISSMANIYNEKILKEGNQLTESIFIQNSKLYFFGILFNGLTLGLQRSNRDQIKNCGFFYGHSAFSVALIFVTAFQGLSVAFILKFLDNMFHVLMAQVTTVIITTVSVLVFDFRPSLEFFLEAPSVLLSIFIYNASKPQVPEYAPRQERIRDLSGNLWERSSG

SEQ ID NO: 798474 - protein, 112 aa, Homo sapiens
SGVEKLQGTQKTQTTEFEGLLANSGTYGKTQMNHQLVSLCHPGWSGAITAHCSLDLPDSSDPPTTASQVARTTGECSAKLCNKFQASSGQLLSFLRKLTFSPWSDGTESRKL

SEQ ID NO: 798475 - protein, 546 aa, Homo sapiens
EVDTWLPSVPAEEVQQPEMAAVLNAERLEVSVDGLTLSPDPEERPGAEGAPLLPPPLPPPSPPGSGRGPGASGEQPEPGEAAAGGAAEEARRLEQRWGFGLEELYGLALRFFKEKDGKAFHPTYEEKLKLVALHKQVLMGPYNPDTCPEVGFFDVLGNDRRREWAALGNMSKEDAMVEFVKLLNRCCHLFSTYVASHKIEKEEQDKKRKEEEERRRREEEERERLQKEEEKRRREEEERLRREEEERRRIEEERLRLEQQKQQIMAALNSQTAVQFQQYAAQQYPGNYEQQQILIRQLQEQHYQQYMQQLYQVQLAQQQAALQKQQEVVVAGSSLPTSSKVNATVPSNMMSVNGQAKTHTDSSEKELEPEAAEEALENGPKESLPVIAAPSMWTRPQIKDFKEKIQQDADSVITVGRGEVVTVRVPTHEEGSYLFWEFATDNYDIGFGVYFEWTDSPNTAVSVHVSESSDDDEEEEENIGCEEKAKKNANKPLLDEIVPVYRRDCHEEVYAGSHQYPGRGVYLLKFDNSYSLWRSKSVYYRVYYTR

SEQ ID NO: 798476 - protein, 208 aa, Homo sapiens
EVDTWLPSVPAEEVQQPEMAAVLNAERLEVSVDGLTLSPDPEERPGAEGAPLLPPPLPPPSPPGSGRGPGASGEQPEPGEAAAGGAAEEARRLEQRWGFGLEELYGLALRFFKEKDGKAFHPTYEEKLKLVALHKQVLMGPYNPDTCPEVGFFDVLGNDRRREWAALGNMSKEDAMVEFVKLLNRCCHLFSTYVASHKIEKEEQDKKR

SEQ ID NO: 798477 - protein, 546 aa, Homo sapiens; identical to SEQ ID NO: 798475

SEQ ID NO: 798478 - protein, 269 aa, Homo sapiens
EVDTWLPSVPAEEVQQPEMAAVLNAERLEVSVDGLTLSPDPEERPGAEGAPLLPPPLPPPSPPGSGRGPGASGEQPEPGEAAAGGAAEEARRLEQRWGFGLEELYGLALRFFKEKDGKAFHPTYEEKLKLVALHKQVLMGPYNPDTCPEVGFFDVLGNDRRREWAALGNMSKEDAMVEFVKLLNRCCHLFSTYVASHKIEKEEQDKKRKEEEERRRREEEERERLQKEEEKRRREEEERLRREEEERRRIEEERLRLEQQKQHYRNNRK

SEQ ID NO: 798479 - protein, 363 aa, Homo sapiens
PKKWSLFEYPPMKKDHISFEEFATEKEEEERRRREEEERERLQKEEEKRRREEEERLRREEEERRRIEEERLRLEQQKQQIMAALNSQTAVQFQQYAAQQYPGNYEQQQILIRQLQEQHYQQYMQQLYQVQLAQQQAALQKQQEVVVAGSSLPTSSKVNATVPSNMMSVNGQAKTHTDSSEKELEPEAAEEALENGPKESLPVIAAPSMWTRPQIKDFKEKIQQDADSVITVGRGEVVTVRVPTHEEGSYLFWEFATDNYDIGFGVYFEWTDSPNTAVSVHVSESSDDDEEEEENIGCEEKAKKNANKPLLDEIVPVYRRDCHEEVYAGSHQYPGRGVYLLKFDNSYSLWRSKSVYYRVYYTR

SEQ ID NO: 798480 - protein, 546 aa, Homo sapiens; identical to SEQ ID NO: 798475

SEQ ID NO: 798481 - protein, 117 aa, Homo sapiens
VKAYRRPTRSGILNGQTLQTLLSACMSVSPAMTTRRKKKTSVVKRKPKRMPTSLCWMRLCLCTDGTVMRRCMLAAINIQGEESISSSLTTPTLCGGQNQSTTESIILDKNVVTKSGV

SEQ ID NO: 798482 - protein, 440 aa, Homo sapiens
EVDTWLPSVPAEEVQQPEMAAVLNAERLEVSVDGLTLSPDPEERPGAEGAPLLPPPLPPPSPPGSGRGPGASGEQPEPGEAAAGGAAEEARRLEQRWGFGLEELYGLALRFFKEKDGKAFHPTYEEKLKLVALHKQVLMGPYNPDTCPEVGFFDVLGNDRRREWAALGNMSKEDAMVEFVKLLNRCCHLFSTYVASHKIEKEEQDKKRKEEEERRRREEEERERLQKEEEKRRREEEERLRREEEERRRIEEERLRLEQQKQQIMAALNSQTAVQFQQYAAQQYPGNYEQQQILIRQLQEQHYQQYMQQLYQVQLAQQQAALQKQQEVVVAGSSLPTSSKVNATVPSNMMSVNGQAKTHTDSSEKELEPEAAEEALENGPKESLPVIAAPSMWTRPQIKDFKEKIQQDADSVITVGRGEVVTVRVPTHEEGSYLFIIHWP

SEQ ID NO: 798483 - protein, 397 aa, Homo sapiens
EVDTWLPSVPAEEVQQPEMAAVLNAERLEVSVDGLTLSPDPEERPGAEGAPLLPPPLPPPSPPGSGRGPGASGEQPEPGEAAAGGAAEEARRLEQRWGFGLEELYGLALRFFKEKDGKAFHPTYEEKLKLVALHKQVLMGPYNPDTCPEVGFFDVLGNDRRREWAALGNMSKEDAMVEFVKLLNRCCHLFSTYVASHKIEKEEQDKKRKEEEERRRREEEERERLQKEEEKRRREEEERLRREEEERRRIEEERLRLEQQKQQIMAALNSQTAVQFQQYAAQQYPGNYEQQQILIRQLQEQHYQQYMQQLYQVQLAQQQAALQKQQEVVVAGSSLPTSSKVNATVPSNMMSVNGQAKTHTDSSEKELEPEAAEEALENGPKGRFCICVCPDVIIPNL

SEQ ID NO: 798484 - protein, 269 aa, Homo sapiens; identical to SEQ ID NO: 798478

SEQ ID NO: 798485 - protein, 120 aa, Homo sapiens
RIQNGTDLAPPGRKQNKCRSRTLYIAGSCSSSGRGWVLPHHLSVLGLRPGSALTDSRLAVNNRIPPEPGNSRSEISVKNERHSAAQPRLQACPAGPVPSLWDGTLWESLLILMVHSFRCP

SEQ ID NO: 798486 - protein, 120 aa, Homo sapiens; identical to SEQ ID NO: 798485

SEQ ID NO: 798487 - protein, 120 aa, Homo sapiens; identical to SEQ ID NO: 798485

SEQ ID NO: 798488 - protein, 120 aa, Homo sapiens; identical to SEQ ID NO: 798485

SEQ ID NO: 798489 - protein, 72 aa, Homo sapiens
MEVSGSSRLSTKREASCEGGCGGGRAYVETLCSLLLSRGLLRLLLNCLRRIQSRRLCAPPPGTLRLGKEIFS

SEQ ID NO: 798490 - protein, 85 aa, Homo sapiens
ASEGLADGCRDHRGLDFEMSRTKCCPFSAALPVSAGTVGAAVQPNFDFRSCMPVKLLMSAVLQDPMRSLSPSTIPLKTVAQNSLE

SEQ ID NO: 798491 - protein, 153 aa, Homo sapiens
MGGSALNQGVLEGDDAPGQSLYERLSQRMLDISGDRGVLKDVIREGAGDLVAPDASVLDITLWGMELGLLSMQRGELARFLFKPNYAYGTLGSPPLIPPNTTVLFKIELLDFLDCAESDKFCALSAVRCRAQMSALYRETNGLVFLVILLDGL

SEQ ID NO: 798492 - protein, 131 aa, Homo sapiens
MGGSALNQGVLEGDDAPGQSLYERLSQRMLDISGDRGVLKDVIREGAGDLVAPDASVLVKYYGYLEHLDRPFDSNYFRKTPRLMKLGEDITLWGMELGLLSMQRGELARCFVLGKLLDSQGPSLHLYLRAS

SEQ ID NO: 798493 - protein, 131 aa, Homo sapiens; identical to SEQ ID NO: 798492

SEQ ID NO: 798494 - protein, 137 aa, Homo sapiens
LRFHPGFGTAAIMAPPVRYCIPGERLCNLEEGSPGSGTYTRHGYIFSSLAGCLMKSSENGALPVVSVVRETESQLLPDVGAIVTCKVSSINSRFAKVHILYVGSMPLKNSFRGTIRKEDVRATEKDKVEIYKSFRPG

SEQ ID NO: 798495 - protein, 71 aa, Homo sapiens
LRFHPGFGTAAIMAPPVRYCIPGERLCNLEEGSPGSGTYTRHGYIFSSLAGCLMKSSENGAVEIYKSFRPG

SEQ ID NO: 798496 - protein, 112 aa, Homo sapiens
LRFHPGFGTAAIMAPPVRYCIPGERLCNLEEGSPGSGTYTRHGYIFSSLAGCLMKSSENGAVSSINSRFAKVHILYVGSMPLKNSFRGTIRKEDVRATEKDKVEIYKSFRPG

SEQ ID NO: 798497 - protein, 116 aa, Homo sapiens
LRFHPGFGTAAIMAPPVRYCIPGERLCNLEEGSPGSGTYTRHGYIFSSLAGCLMKSSENGALPVVSVVRETESQLLPDVGAIVTCKVSSINSRFAKVHILYVGSMPLKNSFRGTIR

SEQ ID NO: 798498 - protein, 107 aa, Homo sapiens
MWGPCLLRTLFEELSARKMSEQLKKTRLKFIRVSAQGDIVLAKVISLGDAQSNYLLTTAENELGVVVAHSESGIQMVPISWCEMQCPKTHTKEFRKVARVQPEFLQT

SEQ ID NO: 798499 - protein, 137 aa, Homo sapiens; identical to SEQ ID NO: 798494

SEQ ID NO: 798500 - protein, 84 aa, Homo sapiens
SGALRIPYEALGDISWQSVTEISLGDAQSNYLLTTAENELGVVVAHSESGIQMVPISWCEMQCPKTHTKEFRKVARVQPEFLQT

SEQ ID NO: 798501 - protein, 137 aa, Homo sapiens; identical to SEQ ID NO: 798494

SEQ ID NO: 798502 - protein, 78 aa, Homo sapiens
LRFHPGFGTAAIMAPPVRYCIPGERLCNLEEGSPGSGTYTRHGYIFSSLAGCLMKSSENGAVKEAACHLPSVFPLGCP

SEQ ID NO: 798503 - protein, 135 aa, Homo sapiens
RRLNGLQLLGARDRCSIFSAGERLCNLEEGSPGSGTYTRHGYIFSSLAGCLMKSSENGALPVVSVVRETESQLLPDVGAIVTCKVSSINSRFAKVHILYVGSMPLKNSFRGTIRKEDVRATEKDKVEIYKSFRPG

SEQ ID NO: 798504 - protein, 137 aa, Homo sapiens; identical to SEQ ID NO: 798494

SEQ ID NO: 798505 - protein, 151 aa, Homo sapiens
LRFHPGFGTAAIMAPPVRYCIPGERLCNLEEGSPGSGTYTRHGYIFSSLAGCLMKSSENGALPVVSVVRETESQLLPDVGAIVTCKVSSINSRFAKVHILYVGSMPLKNSFRGTIRKEDVRATEKDKVSRWFPSAGVRCSALRPTLKNSGK

SEQ ID NO: 798506 - protein, 493 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 798507 - protein, 493 aa, Homo sapiens; identical to SEQ ID NO: 798506

SEQ ID NO: 798508 - protein, 281 aa, Homo sapiens
MEKSTDTDEDNVTRTEYSDKTTQFPSVYAVPGTEQTEAVGGLSSKPATPKTTTPPSSPPPTAVSPEFAYVPADPAQLAAQMLAMATSERGQPPPCSNMWTLYCLTDKNQQGHPSPPPAPGPFPQATLYLPNPKDPQFQQHPPKVTFPTYVMGDTKKTSAPPFILVGSNVQEAQGWKPLPGHAVVSQSDVLRYVAMQVPIAVPADEKYQKHTLSPQNANPPSGQDVPRPKSPVFLSVAFPVEDVAKKSSGSGDKCAPFGSYGIAGEVTVTTAHKRRKAETEN

SEQ ID NO: 798509 - protein, 395 aa, Homo sapiens
MEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSDNTGQEESGENSVPQEMEGKPVLSGEAAEAVHSGTSVKSSSGPFPPAPEGLTAPEIEPEGESTAE

SEQ ID NO: 798510 - protein, 221 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLEDVAKKSSGSGDKCAPFGSYGIAGEVTVTTAHKRRKAETEN

SEQ ID NO: 798511 - protein, 379 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLAMATSERGQPPPCSNMWTLYCLTDKNQQGHPSPPPAPGPFPQATLYLPNPKDPQFQQHPPKVTFPTYVMGDTKKTSAPPFILVGSNVQEAQGWKPLPGHAVVSQSDVLRYVAMQVPIAVPADEKYQKHTLSPQNANPPSGQDVPRPKSPVFLSVAFPVEDVAKKSSGSGDKCAPFGSYGIAGEVTVTTAHKRRKAETEN

SEQ ID NO: 798512 - protein, 493 aa, Homo sapiens; identical to SEQ ID NO: 798506

SEQ ID NO: 798513 - protein, 379 aa, Homo sapiens; identical to SEQ ID NO: 798511

SEQ ID NO: 798514 - protein, 493 aa, Homo sapiens; identical to SEQ ID NO: 798506

SEQ ID NO: 798515 - protein, 442 aa, Homo sapiens
MISSKPRLVVPYGLKTLLEGISRAVLKTNPSNINQFAAAYFQELTMYRGNTTMDIKDLVKQFHQIKVEKWSEGTTPQKKLECLKEPGKTSVESKVPTQMEKSTDTDEDNVTRTEYSDKTTQFPSVYAVPGTEQTEAVGGLSSKPATPKTTTPPSSPPPTAVSPEFAYVPADPAQLAAQMLGKVSSIHSDQSDVLMVDVATSMPVVIKEVPSSEAAEDVMVAAPLVCSGKVLEVQVVNQTSVHVDLGSQPKENEAEPSTASSVPLQDEQEPPAYDQAPEVTLQADIEVMSTVHISSVYNDVPVTEGVVYIEQLPEQIVIPFTDQVACLKENEQSKENEQSPRVSPKSVVEKTTSGMSKKSVESVKLAQLEENAKYSSVYMEAEATALLSDTSLKGQPEVPAQLLDAEGAIKIGSEKSLHLEVEITSIVSAPEGLTAPEIEPEC

SEQ ID NO: 798516 - protein, 395 aa, Homo sapiens; identical to SEQ ID NO: 798509

SEQ ID NO: 798517 - protein, 69 aa, Homo sapiens
TRGVSGTSPNPGPMVQEPGAPEDGHPRLSGERKFTLPPLLCSILAFNKLDDCPPTLVKAIFLLSLPIQC

SEQ ID NO: 798518 - protein, 277 aa, Homo sapiens
KVLSQREGTPAPAEAEQGKSQCPSGSTAQSWSAMDILVPLLQLLVLLLTLPLHLMALLGCWQPLCKSYFPYLMAVLTPKSNRKMESKKRELFSQIKGLTGASGKVALLELGCGTGANFQFYPPGCRVTCLDPNPHFEKFLTKSMAENRHLQYERFVVAPGEDMRQLADGSMDVVVCTLVLCSVQSPRKVLQEVRRVLRPGGVLFFWEHVAEPYGSWAFMWQQVFEPTWKHIGDGCCLTRETWKDLENAQFSEIQMERQPPPLKWLPVGPHIMGKAVK

SEQ ID NO: 798519 - protein, 259 aa, Homo sapiens
KVLSQREGTPAPAEAEQGKSQCPSGSTAQSWSAMDILVPLLQLLVLLLTLPLHLMALLGCWQPLCMESKKRELFSQIKGLTGASGKVALLELGCGTGANFQFYPPGCRVTCLDPNPHFEKFLTKSMAENRHLQYERFVVAPGEDMRQLADGSMDVVVCTLVLCSVQSPRKVLQEVRRVLRPGGVLFFWEHVAEPYGSWAFMWQQVFEPTWKHIGDGCCLTRETWKDLENAQFSEIQMERQPPPLKWLPVGPHIMGKAVK

SEQ ID NO: 798520 - protein, 159 aa, Homo sapiens
MNRKKLQKLTDTLTKNCKHLFRGFDKDNDGCVNVLEWIHGLSLFLRGSLEEKMKYCFEVFDLNGDGFISKEEMFHMLKNSLLKQPSEEDPDEGIKDLVEITLKKMDHDHDGKLSFADYELAVREETLLLEAFGPCLPDPKSQMEFEAQVFKDPNEFNDM

SEQ ID NO: 798521 - protein, 211 aa, Homo sapiens
MNRKKLQKLTDTLTKNCKHFNKFEVNCLIKLFYDLVGGVERQGLVVGLDRNAFRNILHVTFGMTDDMIMDRVFRGFDKDNDGCVNVLEWIHGLSLFLRGSLEEKMKYCFEVFDLNGDGFISKEEMFHMLKNSLLKQPSEEDPDEGIKDLVEITLKKMDHDHDGKLSFADYELAVREETLLLEAFGPCLPDPKSQMEFEAQVFKDPNEFNDM

SEQ ID NO: 798522 - protein, 211 aa, Homo sapiens; identical to SEQ ID NO: 798521

SEQ ID NO: 798523 - protein, 159 aa, Homo sapiens; identical to SEQ ID NO: 798520

SEQ ID NO: 798524 - protein, 211 aa, Homo sapiens; identical to SEQ ID NO: 798521

SEQ ID NO: 798525 - protein, 159 aa, Homo sapiens; identical to SEQ ID NO: 798520

SEQ ID NO: 798526 - protein, 171 aa, Homo sapiens
MNCFSISAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPSLHL

SEQ ID NO: 798527 - protein, 189 aa, Homo sapiens
MNSFSTIPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 798528 - protein, 194 aa, Homo sapiens
MNSFSTSAFGPVAFSLGLLLVLPAAFPAPVPPGEDSKDVAAPHRQPLTSSERIDKQIRYILDGISALRKENLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 798529 - protein, 171 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPSLHL

SEQ ID NO: 798530 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 798531 - protein, 221 aa, Homo sapiens
SCAVSSPLRSLPSGTGAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 798532 - protein, 136 aa, Homo sapiens
MCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 798533 - protein, 198 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKVGVSSFPQLGVGEDRLKDSVLDNSGMQCHFQKRRLHVNKRV

SEQ ID NO: 798534 - protein, 166 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLREAEESSKIRAPTTMKKFEDSEKGYGKDAAGIAMEAIAFGTVHGK

SEQ ID NO: 798535 - protein, 638 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLREAEESSKIRAPTTMKKFEDSEKAKKPVRSMIETRGEKPKEKAKNSKKKGAKKEGSDGPLATSKPVPAEKSGLPVGPENGVELSKEELIRRKREEFIQKHGRGMEKSNKSTKSDAPKEKGKKAPRVWELGGCANKEVLDYSTPTTNGTPEAALSEDINLIRGTGSGGQLQDLDCSSSDDEGAAQNSTKPSATKGTLGGMFGMLKGLVGSKSLSREDMESVLDKMRDHLIAKNVAADIAVQLCESVANKLEGKVMGTFSTVTSTVKQALQESLVQILQPQRRVDMLRDIMDAQRRQRPYVVTFCGVNGVGKSTNLAKISFWLLENGFSVLIAACDTFRAGAVEQLRTHTRRLSALHPPEKHGGRTMVQLFEKGYGKDAAGIAMEAIAFARNQGFDVVLVDTAGRMQDNAPLMTALAKLITVNTPDLVLFVGEALVGNEAVDQLVKFNRALADHSMAQTPRLIDGIVLTKFDTIDDKVGAAISMTYITSKPIVFVGTGQTYCDLRSLNAKAVVAALMKA

SEQ ID NO: 798536 - protein, 638 aa, Homo sapiens; identical to SEQ ID NO: 798535

SEQ ID NO: 798537 - protein, 491 aa, Homo sapiens
MALLHVTKALTWCVVDTAGRMQDKCPSDDCPGQTHYCAEYQPDLVLYVERSLSRHMKPWTSWSSSTEPMADHSMAQTPRLIDGIVLTKFDTMDDQRWEAAISMTYITSKPSSNVGTGRPTVTTQLNAKAVVAALMKAESGSCPIPDRRFPHKPFFLYLNSTKPCATKGTLGGMFGMLKGLVGSKSLSREDMESVLDKMRDHLIAKNVAADIAVQLCESVANKLEGKVMGTFSTVTSTVKQALQESLVQILQPQRRVDMLRDIMDAQRRQRPYVVTFCGVNGVGKSTNLAKISFWLLENGFSVLIAACDTFRAGAVEQLRTHTRRLSALHPPEKHGGRTMVQLFEKGYGKDAAGIAMEAIAFARNQGFDVVLVDTAGRMQDNAPLMTALAKLITVNTPDLVLFVGEALVGNEAVDQLVKFNRALADHSMAQTPRLIDGIVLTKFDTIDDKVGAAISMTYITSKPIVFVGTGQTYCDLRSLNAKAVVAALMKA

SEQ ID NO: 798538 - protein, 638 aa, Homo sapiens; identical to SEQ ID NO: 798535

SEQ ID NO: 798539 - protein, 115 aa, Homo sapiens
ERVGRPTRPAALAKLITVNTPDLVLFVGEALVGNEAVDQLVKFNRALADHSMAQTPRLIDGIVLTKFDTIDDKVGAAISMTYITSKPIVFVGTGQTYCDLRSLNAKAVVAALMKA

SEQ ID NO: 798540 - protein, 101 aa, Homo sapiens
RNAWVDPRVRLFVGEALVGNEAVDQLVKFNRALADHSMAQTPRLIDGIVLTKFDTIDDKVGAAISMTYITSKPIVFVGTGQTYCDLRSLNAKAVVAALMKA

SEQ ID NO: 798541 - protein, 638 aa, Homo sapiens; identical to SEQ ID NO: 798535

SEQ ID NO: 798542 - protein, 117 aa, Homo sapiens
MCFRVCEQPVFSVVQRQSEGACGSFQPHSPFSTAAICKEGLIMLQSLPTDPLPAGLPLPTQAPPSLCLQTQSYYSFDQWLEPNTRALLIISVVKSRLSLMSPSCIRLRDSSRASARS

SEQ ID NO: 798543 - protein, 638 aa, Homo sapiens; identical to SEQ ID NO: 798535

SEQ ID NO: 798544 - protein, 638 aa, Homo sapiens; identical to SEQ ID NO: 798535

SEQ ID NO: 798545 - protein, 643 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLREAEESSKIRAPTTMKKFEDSEKAKKPVRSMIETRGEKPKEKAKNSKKKGAKKEGSDGPLATSKPVPAEKSGLPVGPENGVELSKEELIRRKREEFIQKHGRGMEKSNKSTKSDAPKEKGKKAPRVWELGGCANKEVLDYSTPTTNGTPEAALSEDINLIRGTGSGGQLQDLDCSSSDDEGAAQNSTKPSATKGTLGGMFGMLKGLVGSKSLSREDMESVLDKMRDHLIAKNVAADIAVQLCESVANKLEGKVMGTFSTVTSTVKQALQESLVQILQPQRRVDMLRDIMDAQRRQRPYVVTFCGVNGVGKSTNLAKISFWLLENGFSVLIAACDTFRAGAVEQLRTHTRRLSALHPPEKHGGRTMVQLFEKGYGKDAAGIAMEAIAFARNQGFDVVLVDTAGRMQDNAPLMTALAKLITVNTPDLVLFVGEALVGNEAVDQLVKFNRALADHSMAQTPRLIDGIVLTKFDTIDDKVVHGFIAYYGFSYKQDQIRCIDSHEYGQGSHHRGIVLHAVCRVHQCI

SEQ ID NO: 798546 - protein, 502 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLREAEESSKIRAPTTMKKFEDSEKAKKPVRSMIETRGEKPKEKAKNSKKKGAKKEGSDGPLATSKPVPAEKSGLPVGPENGVELSKEELIRRKREEFIQKHGRGMEKSNKSTKSDAPKEKGKKAPRVWELGGCANKEVLDYSTPTTNGTPEAALSEDINLIRGTGSGGQLQDLDCSSSDDEGAAQNSTKPSATKGTLGGMFGMLKGLVGSKSLSREDMESVLDKMRDHLIGKNVAADHCPFPGSAGLLTTKQSWDRERDCGNVTAPGAHPQTNQALQEFPEMTQFLQGHTGPLLRTGGIQGDTRMGIAPSMHQHKKALLNSPETTHFRSQTHYNLEQLRGNKFYTVKALEQQSSSHITKSYRYTQRKSGLRKQDNTTTLARA

SEQ ID NO: 798547 - protein, 122 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLR

SEQ ID NO: 798548 - protein, 138 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLREAGSSKIHAQPRDGIL

SEQ ID NO: 798549 - protein, 112 aa, Homo sapiens
MCFRVCEQPVFSVVQRQSEGACGSFQPHSPFSTAAICKEGLIMLQSLPTDPLPAGLPLPTQAPPSLCLQTQSYYSFDQWLEPNTRALLIISVVKSRLSLMSPSCIRLRDSSR

SEQ ID NO: 798550 - protein, 638 aa, Homo sapiens; identical to SEQ ID NO: 798535

SEQ ID NO: 798551 - protein, 104 aa, Homo sapiens
DSGVSRFIADTSHEALTLKYKLDNQFELVFVVGFQKILTLTYVDKLIDDVHRLFRDKYRTEIQQQSALSLLNGTFDFQNDFLRLLREAEESSKILCSCYNRVDK

SEQ ID NO: 798552 - protein, 516 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLREAEESSKIRAPTTMKKFEDSEKAKKPVRSMIETRGEKPKEKAKNSKKKGAKKEGSDGPLATSKPVPAEKSGLPVGPENGVELSKEELIRRKREEFIQKHGRGMEKSNKSTKSDAPKEKGKKAPRVWELGGCANKEVLDYSTPTTNGTPEAALSEDINLIRGTGSGGQLQDLDCSSSDDEGAAQNSTKPSATKGTLGGMFGMLKGLVGSKSLSREDMESVLDKMRDHLIAKNVAADIAVQLCESVANKLEGKVMGTFSTVTSTVKQALQESLVQILQPQRRVDMLRDIMDAQRRQRPYVVTFCGVNGVGKSTNLAKISFWLLENGFSVLIAACDTFRAGAVEQLRTHTRRLSALHPPEKHGGRTMVQLFEKGYGKDAAGIAMEAIAFGQVQQSLG

SEQ ID NO: 798553 - protein, 503 aa, Homo sapiens [sequence omitted]

SEQ ID NO: 798554 - protein, 234 aa, Homo sapiens
MLRDIMDAQRRQRPYVVTFCGVNGVGKSTNLAKISFWLLENGFSVLIAACDTFRAGAVEQLRTHTRRLSALHPPEKHGGRTMVQLFEKGYGKDAAGIAMEAIAFARNQGFDVVLVDTAGRMQDNAPLMTALAKLITVNTPDLVLFVGEALVGNEAVDQLVKFNRALADHSMAQTPRLIDGIVLTKFDTIDDKVGAAISMTYITSKPIVFVGTGQTYCDLRSLNAKAVVAALMKA

SEQ ID NO: 798555 - protein, 638 aa, Homo sapiens; identical to SEQ ID NO: 798535

SEQ ID NO: 798556 - protein, 145 aa, Homo sapiens
SGAQLHANLPTLPTRPRNQGFDVVLVDTAGRMQDNAPLMTALAKLITVNTPDLVLFVGEALVGNEAVDQLVKFNRALADHSMAQTPRLIDGIVLTKFDTIDDKVGAAISMTYITSKPIVFVGTGQTYCDLRSLNAKAVVAALMKA

SEQ ID NO: 798557 - protein, 638 aa, Homo sapiens; identical to SEQ ID NO: 798535

SEQ ID NO: 798558 - protein, 119 aa, Homo sapiens
RGGGGPAEGLPTKRRRGDTAAAADKPPRRPATTQPEGGGQPEAAAGTAGSTEPAPPGQTPRLIDGIVLTKFDTIDDKVGAAISMTYITSKPIVFVGTGQTYCDLRSLNAKAVVAALMKA

SEQ ID NO: 798559 - protein, 638 aa, Homo sapiens; identical to SEQ ID NO: 798535

SEQ ID NO: 798560 - protein, 117 aa, Homo sapiens; identical to SEQ ID NO: 798542

SEQ ID NO: 798561 - protein, 638 aa, Homo sapiens; identical to SEQ ID NO: 798535

SEQ ID NO: 798562 - protein, 638 aa, Homo sapiens; identical to SEQ ID NO: 798535

SEQ ID NO: 798563 - protein, 638 aa, Homo sapiens; identical to SEQ ID NO: 798535

SEQ ID NO: 798564 - protein, 591 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLREAEESSKIRAPTTMKKFEDSEKAKKPVRSMIETRGEKPKEKAKNSKKKGAKKEGSDGPLATSKPVPAEKSGLPVGPENGVELSKEELIRRKREEFIQKHGRGMEKSNKSTKSDAPKEKGKKAPRVWELGGCANKEVLDYSTPTTNGTPEAALSEDINLIRGTGSGGQLQDLDCSSSDDEGAAQNSTKPSATKGTLGGMFGMLKGLVGSKSLSREDMESVLDKMRDHLIAKNVAADIAVQLCESVANKLEGKVMGTFSTVTSTVKQALQESLVQILQPQRRVDMLRDIMDAQRRQRPYVVTFCGVNGVGKSTNLAKISFWLLENGFSVLIAACDTFRAGAVEQLRTHTRRLSALHPPEKHGGRTMVQLFEKGYGKDAAGIAMEAIAFARNQGFDVVLVDTAGRMQDNAPLMTALAKLITVNTPDLVLFVGEALVGNEAVDQLLNGIKFGKNNAINEPRCLSHRMVSQALL

SEQ ID NO: 798565 - protein, 313 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLREAEESSKIRAPTTMKKFEDSEKAKKPVRSMIETRGEKPKEKAKNSKKKGAKKEGSDGPLATSKPVPAEKSGLPVGPENGVELSKEELIRRKREEFIQKHGRGMEKSNKSTKSDAPKEKGKKAPRVWELGGCANKEVLDYSTPTTNGTPEAALSEDINLIRGTGSGGQLQDLDCSSSDDEEHKPLVKTCPVA

SEQ ID NO: 798566 - protein, 120 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDITPLYSAW

SEQ ID NO: 798567 - protein, 120 aa, Homo sapiens; identical to SEQ ID NO: 798566

SEQ ID NO: 798568 - protein, 140 aa, Homo sapiens
MLDFFTIFSKGGLVLWCFQGVSDSCTGPVNALIRSVLLQERGGNNSFTHEALTLKYKLDNQFELVFVVGFQKILTLTYVDKLIDDVHRLFRDKYRTEIQQQSALSLLNGTFDFQNDFLRLLREAEESSKILCSCYNRVDK

SEQ ID NO: 798569 - protein, 75 aa, Homo sapiens
SSSFSCQLPKRSLDPKSTLLLSLSSGGSSADWIPIASERRGLEPAAGPSRMGQGTRNALPTGMAWRPSAKSPLFP

SEQ ID NO: 798570 - protein, 75 aa, Homo sapiens; identical to SEQ ID NO: 798569

SEQ ID NO: 798571 - protein, 129 aa, Homo sapiens
PRNFLDAVRARWCYLELKKLHASVKLLTMGQRNKLRGPKSRNVFHIASQKNFKAKNKAKPVTTNLKKINIMNEEKVNRVNKAFVNVQKELAHFAKSISLEPLQKELIPQQRHESKPVNVDEATRLMALL

SEQ ID NO: 798572 - protein, 110 aa, Homo sapiens
ARYPLVRETMGQRNKLRGPKSRNVFHIASQKNFKAKNKAKPVTTNLKKINIMNEEKVNRVNKAFVNVQKELAHFAKSISLEPLQKELIPQQRHESKPVNVDEATRLMALL

SEQ ID NO: 798573 - protein, 129 aa, Homo sapiens; identical to SEQ ID NO: 798571

SEQ ID NO: 798574 - protein, 138 aa, Homo sapiens
IGREKLGISTFHLYRSTVTLCSARCPCCTISASASTLLPLIITSQFLVISRLITVKMVIQRSIANFSRTNALVRETMGQRNKLRGPKSRNVFHIASQKNFKAKNKAKPVTTNLKKIPQQRHESKPVNVDEATRLMALL

SEQ ID NO: 798575 - protein, 124 aa, Homo sapiens
PRNFLDAVRARWCYLELKKLHASVKLLTMGQRNKLRGPKSRNVFHIASQKNFKAKNKAKPVTTNLKKINIMNEEKVNRVNKAFVNVQKELAHFAKSISLEPLQKELIPQQRHESRPVNVDEATR

SEQ ID NO: 798576 - protein, 105 aa, Homo sapiens
MFKTMGQRNKLRGPKSRNVFHIASQKNFKAKNKAKPVTTNLKKINIMNEEKVNRVNKAFVNVQKELAHFAKSISLEPLQKELIPQQRHESKPVNVDEATRLMALL

SEQ ID NO: 798577 - protein, 129 aa, Homo sapiens; identical to SEQ ID NO: 798571

SEQ ID NO: 798578 - protein, 64 aa, Homo sapiens
MAHKKPQINRRLIIRPAAAAHNRHARHKRTVLNEGHLVGGDNDTHHDTSRASNNTSQGEPHRSS

SEQ ID NO: 798579 - protein, 71 aa, Homo sapiens
PRNFLDAVRARWCYLELKKLHASVKLLTMGQRNKLRGPKSRNVFHIASQKNFKAKNKAKPVTTNLKKVSIS

SEQ ID NO: 798580 - protein, 500 aa, Homo sapiens
MSPGLLLLGSAVLLAFGLCCTFVHRARSRYEHIPGPPRPSFLLGHLPCFWKKDEVGGRVLQDVFLDWAKKYGPVVRVNVFHKTSVIVTSPESVKKFLMSTKYNKDSKMYRALQTVFGERLFGQGLVSECNYERWHKQRRVIDLAFSRSSLVSLMETFNEKAEQLVEILEAKADGQTPVSMQDMLTYTAMDILAKAAFGMETSMLLGAQKPLSQAVKLMLEGITASRNTLAKFLPGKRKQLREVRESIRFLRQVGRDWVQRRREALKRGEEVPADILTQILKAEEGAQDDEGLLDNFVTFFIAGHETSANHLAFTVMELSRQPEIVARLQAEVDEVIGSKRYLDFEDLGRLQYLSQVLKESLRLYPPAWGTFRLLEEETLIDGVRVPGNTPLLFSTYVMGRMDTYFEDPLTFNPDRFGPGAPKPRFTYFPFSLGHRSCIGQQFAQMEVKVVMAKLLQRLEFRLVPGQRFGLQEQATLKPLDPVLCTLRPRGWQPAPPPPPC

SEQ ID NO: 798581 - protein, 163 aa, Homo sapiens
MTTLDSNNNTGGVITYIGSSGSSPSRTSPESLYSDNSNGSFQSLTQGCPTYFPPSPTGSLTQDPARSFGSIPPSLSDDGSPSSSSSSSSSSSSFYNGSPPGSLQVAMEDSSRVSPSKSTSNITKLNGMVLLCKVCGDVASGFHYGVHACEGCKVRRTGGKGRG

SEQ ID NO: 798582 - protein, 54 aa, Homo sapiens
MVRFASLFNVKDQTVMFLSRTTYSLQELGAMGMGDLLSAMFDFSEKRKGILYNS

SEQ ID NO: 798583 - protein, 614 aa, Homo sapiens
MTTLDSNNNTGGVITYIGSSGSSPSRTSPESLYSDNSNGSFQSLTQGCPTYFPPSPTGSLTQDPARSFGSIPPSLSDDGSPSSSSSSSSSSSSFYNGSPPGSLQVAMEDSSRVSPSKSTSNITKLNGMVLLCKVCGDVASGFHYGVHACEGCKGFFRRSIQQNIQYKRCLKNENCSIVRINRNRCQQCRFKKCLSVGMSRDAVRFGRIPKREKQRMLAEMQSAMNLANNQLSSQCPLETSPTQHPTPGPMGPSPPPAPVPSPLVGFSQFPQQLTPPRSPSPEPTVEDVISQVARAHREIFTYAHDKLGSSPGNFNANHASGSPPATTPHRWENQGCPPAPNDNNTLAAQRHNEALNGLRQAPSSYPPTWPPGPAHHSCHQSNSNGHRLCPTHVYAAPEGKAPANSPRQGNSKNVLLACPMNMYPHGRSGRTVQEIWEDFSMSFTPAVREVVEFAKHIPGFRDLSQHDQVTLLKAGTFEVLMVRFASLFNVKDQTVMFLSRTTYSLQELGAMGMGDLLSAMFDFSEKLNSLALTEEELGLFTAVVLVSADRSGMENSASVEQLQETLLRALRALVLKNRPLETSRFTKLLLKLPDLRTLNNMHSEKLLSFRVDAQ

SEQ ID NO: 798584 - protein, 614 aa, Homo sapiens; identical to SEQ ID NO: 798583

SEQ ID NO: 798585 - protein, 508 aa, Homo sapiens [sequence omitted]

SEQ ID NO: 798586 - protein, 329 aa, Homo sapiens
MTTLDSNNNTGGVITYIGSSGSSPSRTSPESLYSDNSNGSFQSLTQGCPTYFPPSPTGSLTQDPARSFGSIPPSLSDDGSPSSSSSSSSSSSSFYNGSPPGSLQVAMEDSSRVSPSKSTSNITKLNGMVLLCKVCGDVASGFHYGVHACEGCKGFFRRSIQQNIQYKRCLKNENCSIVRINRNRCQQCRFKKCLSVGMSRDAVRFGRIPKREKQRMLAEMQSAMNLANNQLSSQCPLETSPTQHPTPGPMGPSPPPAPVPSPLVGFSQFPQQLTPPRSPSPEPTVEDVISQVARAHREIFTKLLLKLPDLRTLNNMHSEKLLSFRVDAQ

SEQ ID NO: 798587 - protein, 614 aa, Homo sapiens; identical to SEQ ID NO: 798583

SEQ ID NO: 798588 - protein, 212 aa, Homo sapiens [sequence omitted]

SEQ ID NO: 798589 - protein, 122 aa, Homo sapiens [sequence omitted]

SEQ ID NO: 798590 - protein, 614 aa, Homo sapiens; identical to SEQ ID NO: 798583

SEQ ID NO: 798591 - protein, 602 aa, Homo sapiens [sequence omitted]

SEQ ID NO: 798592 - protein, 602 aa, Homo sapiens [sequence omitted]

SEQ ID NO: 798593 - protein, 687 aa, Homo sapiens
MEEFVGLREGSSGNPVTLQELWGPCPLIRRGIRGGLEWLKQKLFRLGEDWYFLMTLGVLMALVSCAMDLAVESVVRAHQWLYREIGDSHLLRYLSWTVYPVALVSFSSGFSQSITPSSGGSGIPEVKTMLAGVVLEDYLDIKNFGAKVVGLSCTLACGSTLFLGKVGPFVHLSVMMAAYLGRVRTTTIGEPENKSKQNEMLVAAAAVGVATVFGAPFSGVLFSIEVMSSHFSVWDYWRGFFAATCGAFMFRLLAVFNSEQETITSLYKTSFRVDVPFDLPEIFFFVALGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDTPLEEVVKVVTSTDVAEYPLVESTESQILVGIVRRAQLVQALKAEPPSWAPGHQQCLQDILAAGCPTEPVTLKLSPETSLHEAHNLFELLNLHSLFVTSRGRAVGCVSWVEMKKAISNLTNPPAPK

SEQ ID NO: 798594 - protein, 687 aa, Homo sapiens; identical to SEQ ID NO: 798593

SEQ ID NO: 798595 - protein, 687 aa, Homo sapiens; identical to SEQ ID NO: 798593

SEQ ID NO: 798596 - protein, 432 aa, Homo sapiens
ESLNLPLENAWYYNDIAALEFQLFCCGSLKRSCSKTREFPQVACRLLVILCPHPSLNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDTPLEEVVKVVTSTDVAEYPLVESTESQILVGIVRRAQLVQALKAEPPSWAPGHQQCLQDILAAGCPTEPVTLKLSPETSLHEAHNLFELLNLHSLFVTSRGRAVGCVSWVEMKKAISNLTNPPAPK

SEQ ID NO: 798597 - protein, 636 aa, Homo sapiens
MEEFVGLREGSSGNPVTLQELWGPCPLIRRGIRGGLEWLKQKLFRLGEDWYFLMTLGVLMALVSCAMDLAVESVVRAHQWLYREIGDSHLLRYLSWTVYPVALVSFSSGFSQSITPSSGGSGIPEVKTMLAGVVLEDYLDIKNFGAKVVGLSCTLACGSTLFLGKVGPFVHLSVMMAAYLGRVRTTTIGEPENKSKQNEMLVAAAAVGVATVFGAPFSGVLFSIEVMSSHFSVWDYWRGFFAATCGAFMFRLLAVFNSEQETITSLYKTSFRVDVPFDLPEIFFFVALGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDTPLEEVVKVVTSTDVAEYPLVESTESQILVGIVRRAQLVQALKAEPPSWAPGHQQCLQDILAAGCPTEPYLPGAQ

SEQ ID NO: 798598 - protein, 445 aa, Homo sapiens
MEELVGLREGFSGDPVTLQELWGPCPHIRRAIQGGLEWLKQKVFRLGEDWYFLMTLGVLMALVSYAMNFAIGCVVRAHQWLYREIGDSHLLRYLSWTVYPVALVSFSSGFSQSITPSSGGSGIPELKTMLAGVILEDYLDIKNFGAKVVGLSCTLATGSTLFLGKVDGQGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATSRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALA

SEQ ID NO: 798599 - protein, 382 aa, Homo sapiens
MEELVGLREGFSGDPVTLQELWGPCPHIRRAIQGGLEWLKQKVFRLGEDWYFLMTLGVLMALVSYAMNFAIGCVVRAHQWLYREIGDSHLLRYLSWTVYPVALVSFSSGFSQSITPSSGGSGIPELKTMLAGVILEDYLDIKNFGAKVVGLSCTLATGSTLFLGKVDGQGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATRSEPVYSALATLLLASITYPPGVGHFLASRLSMKQHLDSLFDDGSCLERQKSHLGQS

SEQ ID NO: 798600 - protein, 219 aa, Homo sapiens
MEELVGLREGFSGDPVTLQELWGPCPHIRRAIQGGLEWLKQKVFRLGEDWYFLMTLGVLMALVSYAMNFAIGCVVRGFSQSITPSSGGESTVAMPVPSAKTFSDPRGLLMGGVGKGQPHFTDKGPGRVMWLAQRDTARRPDLDFWVTAGPTCFPGAPLGLDGRPGGRIFCEACSSGQCQGGASGGGTAPPGRSALPPAPGQQRGAQSSLSGGLRFHPGF

SEQ ID NO: 798601 - protein, 244 aa, Homo sapiens
MSSHFSVRDYWRGFFAATCGAFIFRLLAVFNSEQETITSLYKTSFRVDVPFDLPEIFFFVALGGICGVLSCAYLFCQRTFLSFIKTNRYSSKLLATRSEPVYSALATLLLASITYPPGVGHFLASRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALA

SEQ ID NO: 798602 - protein, 687 aa, Homo sapiens; identical to SEQ ID NO: 798593

SEQ ID NO: 798603 - protein, 658 aa, Homo sapiens
MEEFVGLREGSSGNPVTLQELWGPCPLIRRGIRGGLEWLKQKLFRLGEDWYFLMTLGVLMALVSCAMDLAVESVVRAHQWLYREIGDSHLLRYLSWTVYPVALVSFSSGFSQSITPSSGGSGIPEVKTMLAGVVLEDYLDIKNFGAKVVGLSCTLACGSTLFLGKVGPFVHLSVMMAAYLGRVRTTTIGEPENKSKQNEMLVAAAAVGVATVFGAPFSGVLFSIEVMSSHFSVWDYWRGFFAATCGAFMFRLLAVFNSEQETITSLYKTSFRVDVPFDLPEIFFFVALGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDTPLEEVVKVVTSTDVAEYPLVESTESQILVGIVRRAQLVQALKAEPPSWAPGHQQCLQDILAAGCPTEPVTLKLSPETSLHEAQMASGVVWFPVRGS

SEQ ID NO: 798604 - protein, 445 aa, Homo sapiens; identical to SEQ ID NO: 798598

SEQ ID NO: 798605 - protein, 457 aa, Homo sapiens
SRLVRSGGVMGLMEELVGLREGFSGDPVTLQELWGPCPHIRRAIQGGLEWLKQKVFRLGEDWYFLMTLGVLMALVSYAMNFAIGCVVRAHQWLYREIGDSHLLRYLSWTVYPVALVSFSSGFSQSITPSSGGSGIPELKTMLAGVILEDYLDIKNFGAKVVGLSCTLATGSTLFLGKVDGQGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATSRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALA

SEQ ID NO: 798606 - protein, 284 aa, Homo sapiens
ISGWATYPRTCGKRRSSSISNGSGIPELKTMLAGVILEDYLDIKNFGAKVVGLSCTLATGSTLFLGKVDGQGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATRSEPVYSALATLLLASITYPPGVGHFLASRLSMKQHLDSLFDDGSCLERQKSHLGQS

SEQ ID NO: 798607 - protein, 161 aa, Homo sapiens
PSTVLLVLESHCYSIPGTLEPETLLLFLGRACLLQLSSLTCIYTAGKMWLQDRIATFFFPKGMMLTTAALMLFFLHLGIFIRDVHNFCITYHYDHMSFHYTVVLMFSQVISICWAAMGSLYAEMTENNAQRSHALQPPVLGVSGHRVPGGAPLRPGESEQG

SEQ ID NO: 798608 - protein, 278 aa, Homo sapiens
PSTVLLVLESHCYSIPGTLEPETLLLFLGRACLLQLSSLTCIYTAGKMWLQDRIATFFFPKGMMLTTAALMLFFLHLGIFIRDVHNFCITYHYDHMSFHYTVVLMFSQVISICWAAMGSLYAEMTENKYVCFSALTILSEWQEGEGARGSGELWNPEMWQGVAREGYWGSWGALSPAQCSTEPCSSTACPWSFWPSSTGRSTTEAWGVGTGLRRGKQKAASGVLIKLLFISTCQLLHGARGRRLETREESKSRQMLDPRGLQAWPAATLVDLALGLGS

SEQ ID NO: 798609 - protein, 129 aa, Homo sapiens
MCYELDSIRILTTGSKSESSGEQEAECLKSSYGTELLDETISGIPHLQAMRTVLWALNCSRLTTMTTSVKMSRLRRRLRLRRTSLAWRVNWIQLSAGEAILSSLEKRGQNPVSPPEPVSCLPQVSEQVA

SEQ ID NO: 798610 - protein, 124 aa, Homo sapiens
ICRSRMQASLWMAPFQWHRDQLTSNDKEEYQHDGIEEPQDEAEDILMGHCGDQEHTQHGYPSGPGTKELAGCCLQGPETESATANKSTSSTPLLLLVPHNDDPLSAGSSQKDYDSPSPCDSHDK

SEQ ID NO: 798611 - protein, 115 aa, Homo sapiens
RDRDGAVFSHQWLAMRQSSGGSKQLPVRFFLGTLPRAVPCAKLHVPFTTGEEQRSEADTLKGCCLQGPETESATANKSTSSTPLLLLVPHNDDPLSAGSSQKDYDSPSPCDSHDK

SEQ ID NO: 798612 - protein, 89 aa, Homo sapiens
PGEGAAAGATAVGAERGPAPLGLQDLVHVVQVLLGGQDLGVVAHLPHFALDGFDLPPLEPLLQGGADCGRGRDKKLSTGCKVPSTQPLH

SEQ ID NO: 798613 - protein, 198 aa, Homo sapiens
GRSGAVSTFTSEVEDSKEENKWGEGRQGRGFGPASGPTGWVGVGRKMGTDGRRAQSQGSPTAPRLLQIVTTTPAISGDFPENSEHGVPDSVSQSWDVIWCQPFRGHWGQHPHLTLSWGKGSTIMACPPRSLPTGGAQLPSDTLPQPFSSLPPTLDNHPWACQLPLLRPFSYTKPSPIPSSDISSAPLQPPSSGFGIYC

SEQ ID NO: 798614 - protein, 172 aa, Homo sapiens
GRSGAVSTFTSEVEDSKEENKWGEGRQGRGFGPASGPTGWVGVGRKMGTDGRRAQSQGSPTAPRLLQIVTTTPAISGDFPENSEHGVPDSVSQSWDVIWCQPFRGHWGQHPHLTLSWGKGSTIMACPPRSLPTGMSSQPLRTHPTPELLKALTRGEATLLLAVEVLDDSRPG

SEQ ID NO: 798615 - protein, 264 aa, Homo sapiens
MFVPCGESAPDLAGFTLLMPAVSVGNVGQLAMDLIISTLNMSKIGYFYTDCLVPMVGNNPYATTEGNSTELSINAEVYSLPSRKLVALQLRSIFIKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 798616 - protein, 257 aa, Homo sapiens
WLNTSLSTPIFRPAVSVGNVGQLAMDLIISTLNMSKIGYFYTDCLVPMVGNNPYATTEGNSTELSINAEVYSLPSRKLVALQLRSIFIKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 798617 - protein, 206 aa, Homo sapiens
AARDARDDEEQQNLANAEVYSLPSRKLVALQLRSIFIKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 798618 - protein, 299 aa, Homo sapiens
KQLYRPNPGSRASAFLLPSFLPGPRLVPAGHPTATMFVPCGESAPDLAGFTLLMPAVSVGNVGQLAMDLIISTLNMSKIGYFYTDCLVPMVGNNPYATTEGNSTELSINAEVYSLPSRKLVALQLRSIFIKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 798619 - protein, 264 aa, Homo sapiens; identical to SEQ ID NO: 798615

SEQ ID NO: 798620 - protein, 264 aa, Homo sapiens; identical to SEQ ID NO: 798615

SEQ ID NO: 798621 - protein, 264 aa, Homo sapiens; identical to SEQ ID NO: 798615

SEQ ID NO: 798622 - protein, 240 aa, Homo sapiens
MFVPCGESAPDLAGFTLLMPAVSVGNVGQLAMDLIISTLNMSKIGYFYTDCLVPMVGNNPYATTEGNSTELSINAEVYSLPSRKLVALQLRSIFIKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQMAVLLKFVSEGDNIPDALGLVEYLNEWLQILKPLVSSIIA

SEQ ID NO: 798623 - protein, 272 aa, Homo sapiens [sequence omitted]

SEQ ID NO: 798624 - protein, 175 aa, Homo sapiens
FSQWCAKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 798625 - protein, 111 aa, Homo sapiens
MVQSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 798626 - protein, 975 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLVEMSEKKALLLNELGGFTITGKYLFGSSQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 798627 - protein, 956 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKGFCQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 798628 - protein, 956 aa, Homo sapiens; identical to SEQ ID NO: 798627

SEQ ID NO: 798629 - protein, 956 aa, Homo sapiens; identical to SEQ ID NO: 798627

SEQ ID NO: 798630 - protein, 953 aa, Homo sapiens
MRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKGFCQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 798631 - protein, 953 aa, Homo sapiens; identical to SEQ ID NO: 798630

SEQ ID NO: 798632 - protein, 956 aa, Homo sapiens; identical to SEQ ID NO: 798627

SEQ ID NO: 798633 - protein, 932 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEETKMDKKRNERYEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 798634 - protein, 964 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKIITIRIFDREEYEKECSFSLVLEEPKWIRRGMKGVRVNKDIPSSQPVFRKVHAREHPILSTVITIADEYDDKQPLTSKEEEERRIAEMGRPILGEHTKLEVIIEESYEFKSTVDKLIKKTNLALVVGTNSWREQFIEAITVSAGEDDDDDECGEEKLPSCFDYVMHFLTVFWKVLFAFVPPTEYWNGWACFIVSILMIGLLTAFIGDLASHFGCTIGLKDSVTAVVFVALGTSVPDTFASKVAATQDQYADASIGNVTGSNAVNVFLGIGVAWSIAAIYHAANGEQFKVSPGTLAFSVTLFTIFAFINVGVLLYRRRPEIGGELGGPRTAKLLTSCLFVLLWLLYIFFSSLEAYCHIKGF

SEQ ID NO: 798635 - protein, 158 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCL

SEQ ID NO: 798636 - protein, 640 aa, Homo sapiens
MYNMRRLSLSPTFSMGFHLLVTVSLLFSHVDHVIAETEMEGEGNETGECTGSYYCKKGVILPIWEPQDPSFGDKIARATVYFVAMVYMFLGVSIIADRFMSSIEVITSQEKEITIKKPNGETTKTTVRIWNETVSNLTLMALGSSAPEILLSVIEVCGHNFTAGDLGPSTIVGSAAFNMFIIIALCVYVVPDGETRKIKHLRVFFVTAAWSIFAYTWLYIILSVISPGVVEVWEGLLTFFFFPICVVFAWVADRRLLFYKYVYKRYRAGKQRGMIIEHEGDRPSSKTEIEMDGKVVNSHVENFLDGALVLEVDERDQDDEEARREMARILKELKQKHPDKEIEQLIELANYQVLSQQQKSRAFYRIQATRLMTGAGNILKRHAADQARKAVSMHEVNTEVTENDPVSKIFFEQGTYQCLENCGTVALTIIRRGGDLTNTVFVDFRTEDGTANAGSDYEFTEGTVVFKPGDTQKEIRVGIIDDDIFEEDENFLVHLSNVKVSSEASEDGILEANHVSTLACLGSPSTATVTIFDDDHAGIFTFEEPVTHVSESIGIMEVKVLRTSGARGNVIVPYKTIEGTARGGGEDFEDTCGELEFQNDEIVKTISVKVIDDEEYEKNKTFFLEIGEPRLEAYCHIKGF

SEQ ID NO: 798637 - protein, 105 aa, Homo sapiens
MVVLRSSLELHNHSAASATGSLDLSSDFLSLEHIGRRRLRSAGAAQKKPAATTAKAGVSTGLRRAPRAVPGGTAGSPALGGAWGWAAPVRVTVVGGEVWSRTSKM

SEQ ID NO: 798638 - protein, 1220 aa, Homo sapiens
MLFDKLITNTAEAVLQKMDDMKKMRRQRMRELEDLGVFNETEESNLNMYTRGKQKDIQRTDEETTDNQEGSVESSEEGEDQEHEDDGEDEDDEDDDDDDDDDDDDDDEDDEDEEDGEEENQKRYYLRQRKATVYYQAPLEKPRHQRKPNIFYSGPASPARPRYRLSSAGPRSPYCKRMNRRRHAIHSSDSTSSSSSEDEQHFERRRKRSRNRAINRCLPLNFRKDELKGIYKDRMKIGASLADVDPMQLDSSVRFDSVGGLSNHIAALKEMVVFPLLYPEVFEKFKIQPPRGCLFYGPPGTGKTLVARALANECSQGDKRVAFFMRKGADCLSKWVGESERQLRLLFDQAYQMRPSIIFFDEIDGLAPVRSSRQDQIHSSIVSTLLALMDGLDSRGEIVVIGATNRLDSIDPALRRPGRFDREFLFSLPDKEARKEILKIHTRDWNPKPLDTFLEELAENCVGYCGADIKSICAEAALCALRRRYPQIYTTSEKLQLDLSSINISAKDFEVAMQKMIPASQRAVTSPGQALSTVVKPLLQNTVDKILEALQRVFPHAEFRTNKTLDSDISCPLLESDLAYSDDDVPSVYENGLSQKSSHKAKDNFNFLHLNRNACYQPMSFRPRILIVGEPGFGQGSHLAPAVIHALEKFTVYTLDIPVLFGVSTTSPEETCAQVIREAKRTAPSIVYVPHIHVWWEIVGPTLKATFTTLLQNIPSFAPVLLLATSDKPHSALPEEVQELFIRDYGEIFNVQLPDKEERTKFFEDLILKQAAKPPISKKKAVLQALEVLPVAPPPEPRSLTAEEVKRLEEQEEDTFRELRIFLRNVTHRLAIDKRFRVFTKPVDPDEVPDYVTVIKQPMDLSSVISKIDLHKYLTVKDYLRDIDLICSNALEYNPDRDPGDRLIRHRACALRDTAYAIIKEELDEDFEQLCEEIQESRKKRGCSSSKYAPSYYHVMPKQNSTLVGDKRSDPEQNEKLKTPSTPVACSTPAQLKRKIRKKSNWYLGTIKKRRKISQAKDDSQNAIDHKIESDTEETQDTSVDHNETGNTGESSVEENEKQQNASESKLELRNNSNTCNIENELEDSRKTTACTELRDKIACNGDASSSQIIHISDENEGKEMCVLRMTRARRSQVEQQQLITVEKALAILSQPTPSLVVDHERLKNLLKTVVKKSQNYNIFQLENLYAVISQCIYRHRKDHDKTSLIQKMEQEVENFSCSR

SEQ ID NO: 798639 - protein, 1390 aa, Homo sapiens
MVVLRSSLELHNHSAASATGSLDLSSDFLSLEHIGRRRLRSAGAAQKKPAATTAKAGDGSSVKEVETYHRTRALRSLRKDAQNSSDSSFEKNVEITEQLANGRHFTRQLARQQADKKKEEHREDKVIPVTRSLRARNIVQSTEHLHEDNGDVEVRRSCRIRSRYSGVNQSMLFDKLITNTAEAVLQKMDDMKKMRRQRMRELEDLGVFNETEESNLNMYTRGKQKDIQRTDEETTDNQEGSVESSEEGEDQEHEDDGEDEDDEDDDDDDDDDDDDDDEDDEDEEDGEEENQKRYYLRQRKATVYYQAPLEKPRHQRKPNIFYSGPASPARPRYRLSSAGPRSPYCKRMNRRRHAIHSSDSTSSSSSEDEQHFERRRKRSRNRAINRCLPLNFRKDELKGIYKDRMKIGASLADVDPMQLDSSVRFDSVGGLSNHIAALKEMVVFPLLYPEVFEKFKIQPPRGCLFYGPPGTGKTLVARALANECSQGDKRVAFFMRKGADCLSKWVGESERQLRLLFDQAYQMRPSIIFFDEIDGLAPVRSSRQDQIHSSIVSTLLALMDGLDSRGEIVVIGATNRLDSIDPALRRPGRFDREFLFSLPDKEARKEILKIHTRDWNPKPLDTFLEELAENCVGYCGADIKSICAEAALCALRRRYPQIYTTSEKLQLDLSSINISAKDFEVAMQKMIPASQRAVTSPGQALSTVVKPLLQNTVDKILEALQRVFPHAEFRTNKTLDSDISCPLLESDLAYSDDDVPSVYENGLSQKSSHKAKDNFNFLHLNRNACYQPMSFRPRILIVGEPGFGQGSHLAPAVIHALEKFTVYTLDIPVLFGVSTTSPEETCAQVIREAKRTAPSIVYVPHIHVWWEIVGPTLKATFTTLLQNIPSFAPVLLLATSDKPHSALPEEVQELFIRDYGEIFNVQLPDKEERTKFFEDLILKQAAKPPISKKKAVLQALEVLPVAPPPEPRSLTAEEVKRLEEQEEDTFRELRIFLRNVTHRLAIDKRFRVFTKPVDPDEVPDYVTVIKQPMDLSSVISKIDLHKYLTVKDYLRDIDLICSNALEYNPDRDPGDRLIRHRACALRDTAYAIIKEELDEDFEQLCEEIQESRKKRGCSSSKYAPSYYHVMPKQNSTLVGDKRSDPEQNEKLKTPSTPVACSTPAQLKRKIRKKSNWYLGTIKKRRKISQAKDDSQNAIDHKIESDTEETQDTSVDHNETGNTGESSVEENEKQQNASESKLELRNNSNTCNIENELEDSRKTTACTELRDKIACNGDASSSQIIHISDENEGKEMCVLRMTRARRSQVEQQQLITVEKALAILSQPTPSLVVDHERLKNLLKTVVKKSQNYNIFQLENLYAVISQCIYRHRKDHDKTSLIQKMEQEVENFSCSR

SEQ ID NO: 798640 - protein, 1380 aa, Homo sapiens
MVVLRSSLELHNHSAASATGSLDLSSDFLSLEHIGRRRLRSAGAAQKKPAATTAKAGDGSSVKEVETYHRTRALRSLRKDAQNSSDSSFEKNVEITEQLANGRHFTRQLARQQADKKKEEHREDKVIPVTRSLRARNIVQSTEHLHEDNGDVEVRRSCRIRSRYSGVNQSMLFDKLITNTAEAVLQKMDDMKKMRRQRMRELEDLGVFNETEESNLNMYTRGKQKDIQRTDEETTDNQEGSVESSEEGEDQEHEDDGEDEDDEDDDDDDDDDDDDDDEDDEDEEDGEEENQKRYYLRQRKATVYYQAPLEKPRHQRKPNIFYSGPASPARPRYRLSSAGPRSPYCKRMNRRRHAIHSSDSTSSSSSEDEQHFERRRKRSRNRAINRCLPLNFRKDELKGIYKDRMKIGASLADVDPMQLDSSVRFDSVGGLSNHIAALKEMVVFPLLYPEVFEKFKIQPPRGCLFYGPPGTGKTLVARALANECSQGDKRVAFFMRKGADCLSKWVGESERQLRLLFDQAYQMRPSIIFFDEIDGLAPVRSSRQDQIHSSIVSTLLALMDGLDSRGEIVVIGATNRLDSIDPALRRPGRFDREFLFSLPDKEARKEILKIHTRDWNPKPLDTFLEELAENCVGYCGADIKSICAEAALCALRRRYPQIYTTSEKLQLDLSSINISAKDFEVAMQKMIPASQRAVTSPGQALSTVVKPLLQNTVDKILEALQRVFPHAEFRTNKTLDSDISCPLLESDLAYSDDDVPSVYENGLSQKSSHKAKDNFNFLHLNRNACYQPMSFRPRILIVGEPGFGQGSHLAPAVIHALEKFTVYTLDIPVLFGVSTTSPEETCAQVIREAKRTAPSIVYVPHIHVWWEIVGPTLKATFTTLLQNIPSFAPVLLLATSDKPHSALPEEVQELFIRDYGEIFNVQLPDKEERTKFFEDLILKQAAKPPISKKKAVLQALEVLPVAPPPEPRSLTAEEVKRLEEQEEDTFRELRIFLRNVTHRLAIDKRFRVFTKPVDPDEVPDYVTVIKQPMDLSSVISKIDLHKYLTVKDYLRDIDLICSNALEYNPDRDPGDRLIRHRACALRDTAYAIIKEELDEDFEQLCEEIQESRKKRGCSSSKYAPSYYHVMPKQNSTLVGDKRSDPEQNEKLKTPSTPVACSTPAQLKRKIRKKSNWYLGTIKKRRKISQAKDDSQNAIDHKIESDTEETQDTSVDHNETGNTGESSVEENEKQQNASESKLELRNNSNTCNIENELEDSRKTTACTELRDKIACNGDASSSQIIHISDENEGKEMCVLRMTRARRSQVEQQQLITVEKALAILSQPTPSLVVDHERLKNLLKTVVKKSQNYNIFQLENLYAVISQCIYRHRKDHDKTSLIQVNS

SEQ ID NO: 798641 - protein, 316 aa, Homo sapiens
MARQYLLKHRLYAIIKEELDEDFEQLCEEIQESRKKRGCSSSKYAPSYYHVMPKQNSTLVGDKRSDPEQNEKLKTPSTPVACSTPAQLKRKIRKKSNWYLGTIKKRRKISQAKDDSQNAIDHKIESDTEETQDTSVDHNETGNTGESSVEENEKQQNASESKLELRNNSNTCNIENELEDSRKTTACTELRDKIACNGDASSSQIIHISDENEGKEMCVLRMTRARRSQVEQQQLITVEKALAILSQPTPSLVVDHERLKNLLKTVVKKSQNYNIFQLENLYAVISQCIYRHRKDHDKTSLIQKMEQEVENFSCSR

SEQ ID NO: 798642 - protein, 549 aa, Homo sapiens
MVVLRSSLELHNHSAASATGSLDLSSDFLSLEHIGRRRLRSAGAAQKKPAATTAKAGDGSSVKEVETYHRTRALRSLRKDAQNSSDSSFEKNVEITEQLANGRHFTRQLARQQADKKKEEHREDKVIPVTRSLRARNIVQSTEHLHEDNGDVEVRRSCRIRSRYSGVNQSMLFDKLITNTAEAVLQKMDDMKKMRRQRMRELEDLGVFNETEESNLNMYTRGKQKDIQRTDEETTDNQEGSVESSEEGEDQEHEDDGEDEDDEDDDDDDDDDDDDDDEDDEDEEDGEEENQKRYYLRQRKATVYYQAPLEKPRHQRKPNIFYSGPASPARPRYRLSSAGPRSPYCKRMNRRRHAIHSSDSTSSSSSEDEQHFERRRKRSRNRAINRCLPLNFRKDELKGIYKDRMKIGASLADVDPMQLDSSVRFDSVGGLSNHIAALKEMVVFPLLYPEVFEKFKIQPPRGCLFYGPPGTGKTLVARALANECSQGDKRVAFFMRKGADCLSKWVGESERQLRLLFDQAYQMRPSIIFFDEIDGLAPVRSSRQDQIHR

SEQ ID NO: 798643 - protein, 219 aa, Homo sapiens
MVVLRSSLELHNHSAASATGSLDLSSDFLSLEHIGRRRLRSAGAAQKKPAATTAKAGDGSSVKEVETYHRTRALRSLRKDAQNSSDSSFEKNVEITEQLANGRHFTRQLARQQADKKKEEHREDKVIPVTRSLRARNIVQSTEHLHEDNGDVEVRRSCRIRSRYSGVNQSMLFDKLITNTAEAVLQKMDDMKKMRRQRMRELEDLGVFNETEEVNIFFH

SEQ ID NO: 798644 - protein, 148 aa, Homo sapiens
FSQYALFLFLYFNHTKYCGFSLFILSYIRVFHSLNFRKWLNVLSSFFFKFLEAQLKRKIRKKSNWYLGTIKKRRKISQAKDDSQNAIDHKIESDTEETQDTSVDHNETGNTGESSVEENEKQQNASESKLELRNNSNTCNIENELEDS

SEQ ID NO: 798645 - protein, 939 aa, Homo sapiens
MVVLRSSLELHNHSAASATGSLDLSSDFLSLEHIGRRRLRSAGAAQKKPAATTAKAGDGSSVKEVETYHRTRALRSLRKDAQNSSDSSFEKNVEITEQLANGRHFTRQLARQQADKKKEEHREDKVIPVTRSLRARNIVQSTEHLHEDNGDVEVRRSCRIRSRYSGVNQSMLFDKLITNTAEAVLQKMDDMKKMRRQRMRELEDLGVFNETEESNLNMYTRGKQKDIQRTDEETTDNQEGSVESSEEGEDQEHEDDGEDEDDEDDDDDDDDDDDDDDEDDEDEEDGEEENQKRYYLRQRKATVYYQAPLEKPRHQRKPNIFYSGPASPARPRYRLSSAGPRSPYCKRMNRRRHAIHSSDSTSSSSSEDEQHFERRRKRSRNRAINRCLPLNFRKDELKGIYKDRMKIGASLADVDPMQLDSSVRFDSVGGLSNHIAALKEMVVFPLLYPEVFEKFKIQPPRGCLFYGPPGTGKTLVARALANECSQGDKRVAFFMRKGADCLSKWVGESERQLRLLFDQAYQMRPSIIFFDEIDGLAPVRSSRQDQIHSSIVSTLLALMDGLDSRGEIVVIGATNRLDSIDPALRRPGRFDREFLFSLPDKEARKEILKIHTRDWNPKPLDTFLEELAENCVGYCGADIKSICAEAALCALRRRYPQIYTTSEKLQLDLSSINISAKDFEVAMQKMIPASQRAVTSPGQALSTVVKPLLQNTVDKILEALQRVFPHAEFRTNKTLDSDISCPLLESDLAYSDDDVPSVYENGLSQKSSHKAKDNFNFLHLNRNACYQPMSFRPRILIVGEPGFGQGSHLAPAVIHALEKFTVYTLDIPVLFGVSTTSPEETCAQVIREAKRTAPSIVYVPHIHVWWEIVGPTLKATFTTLLQNIPSFAPVLLLATSDKPHSALPEEVIYVGRYHYTFKKSCFYHNNHNLLKKFKCCRSE

SEQ ID NO: 798646 - protein, 1390 aa, Homo sapiens; identical to SEQ ID NO: 798639

SEQ ID NO: 798647 - protein, 1390 aa, Homo sapiens; identical to SEQ ID NO: 798639

SEQ ID NO: 798648 - protein, 362 aa, Homo sapiens
MDLSSVISKIDLHKYLTVKDYLRDIDLICSNALEYNPDRDPGDRLIRHRACALRDTAYAIIKEELDEDFEQLCEEIQESRKKRGCSSSKYAPSYYHVMPKQNSTLVGDKRSDPEQNEKLKTPSTPVACSTPAQLKRKIRKKSNWYLGTIKKRRKISQAKDDSQNAIDHKIESDTEETQDTSVDHNETGNTGESSVEENEKQQNASESKLELRNNSNTCNIENELEDSRKTTACTELRDKIACNGDASSSQIIHISDENEGKEMCVLRMTRARRSQVEQQQLITVEKALAILSQPTPSLVVDHERLKNLLKTVVKKSQNYNIFQLENLYAVISQCIYRHRKDHDKTSLIQKMEQEVENFSCSR

SEQ ID NO: 798649 - protein, 1390 aa, Homo sapiens; identical to SEQ ID NO: 798639

SEQ ID NO: 798650 - protein, 178 aa, Homo sapiens
MGPAPVPPKRGDIENMLQPGAVPPWYLHPGVVRSSWAEPVTCSQARAHSKLTHVVVGVILFLQIVSIPPWLLHRAAHHGSRLHHRQPARGQDKRADEGRYHHRGQFCNLTTRLTYCHFCPILLLEASRYISPTLKGRWSHCGVHWKLPTRLRSSQTHPLAIWCGIGKKTKARYGGSCL

SEQ ID NO: 798651 - protein, 439 aa, Homo sapiens
APARRSVMLFPLQVAAVTSSVRDDPLEHCVSPRTRARSPEICKMADNLDEFIEEQKARLAEDKAELESDPPYMEMKGKLSAKLSENSKILISMAKENIPPNSQQTRGSLGIDYGLSLPLGEDYERKKHKLKEELRQDYRRYLTQERLKLERNKEYNQFLRGKEESSEKFRQVEKSTEPKSQRNKKPIGQVKPDLTSQIQTSCENSEGPRKDVLTPSEAYEELLNQRRLEEDRYRQLDDEIELRNRRIIKKANEEVGISNLKHQRFASKAGIPDRRFHRFNEDRVFDRRYHRPDQDPEVSEEMDERFRYESDFDRRLSRVYTNDGLPFASLPIHFGTNIELLMMMHTILWVRNNFDPSLAIMVRNDGVSWNYVMSVTTIKNCGIRGEDRDTRNETGDLRERTSKFFKVRLHTNSNHTYYMNPEGRKIGNTQGIQLELAKG

SEQ ID NO: 798652 - protein, 144 aa, Homo sapiens
APARRSVMLFPLQVAAVTSSVRDDPLEHCVSPRTRARSPEICKMADNLDEFIEEQKARLAEDKAELESDPPYMEMKGKLSAKLSENSKILISMAKENIPPNSQQTRGSLGIDYGLSLPLGEDYERKKHKLKEELRQDYRRYLTQ

SEQ ID NO: 798653 - protein, 466 aa, Homo sapiens
APARRSVMLFPLQVAAVTSSVRDDPLEHCVSPRTRARSPEICKMADNLDEFIEEQKARLAEDKAELESDPPYMEMKGKLSAKLSENSKILISMAKENIPPNSQQTRGSLGIDYGLSLPLGEDYERKKHKLKEELRQDYRRYLTQKNFLSTSETDPSTLGVSLPIGERLSAKERLKLERNKEYNQFLRGKEESSEKFRQVEKSTEPKSQRNKKPIGQVKPDLTSQIQTSCENSEGPRKDVLTPSEAYEELLNQRRLEEDRYRQLDDEIELRNRRIIKKANEEVGISNLKHQRFASKAGIPDRRFHRFNEDRVFDRRYHRPDQDPEVSEEMDERFRYESDFDRRLSRVYTNDGLPFASLPIHFGTNIELLMMMHTILWVRNNFDPSLAIMVRNDGVSWNYVMSVTTIKNCGIRGEDRDTRNETGDLRERTSKFFKVRLHTNSNHTYYMNPEGRKIGNTQGIQLELAKG

SEQ ID NO: 798654 - protein, 2004 aa, Homo sapiens
MVKLANPLYTEWILEAIKKVKKQKQRPSEERICNAVSSSHGLDRKTVLEQLELSVKDGTILKVSNKGLNSYKDPDNPGRIALPKPRNHGKLDNKQNVDWNKLIKRAVEGLAESGGSTLKSIERFLKGQKDVSALFGGSAASGFHQQLRLAIKRAIGHGRLLKDGPLYRLNTKATNVDGKESCESLSCLPPVSLLPHEKDKPVAEPIPICSFCLGTKEQNREKKPEELISCADCGNSGHPSCLKFSPELTVRVKALRWQCIECKTCSSCRDQGKNADNMLFCDSCDRGFHMECCDPPLTRMPKGMWICQICRPRKKGRKLLQKKAAQIKRRYTNPIGRPKNRLKKQNTVSKGPFSKVRTGPGRGRKRKITLSSQSASSSSEEGYLERIDGLDFCRDSNVSLKFNKKTKGLIDGLTKFFTPSPDGRKARGEVVDYSEQYRIRKRGNRKSSTSDWPTDNQDGWDGKQENEERLFGSQEIMTEKDMELFRDIQEQALQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVGKSVSHENKEQDSYSVESEKKPEVMAPVSSTRLSKQVLPHDSLPANSQPSRRGRWGRKNRKTQERFGDKDSKLLLEETSSAPQEQYGECGEKSEATQEQYTESEEQLVASEEQPSQDGKPDLPKRRLSEGVEPWRGQLKKSPEALKCRLTEGSERLPRRYSEGDRAVLRGFSESSEEEEEPESPRSSSPPILTKPTLKRKKPFLHRRRRVRKRKHHNSSVVTETISETTEVLDEPFEDSDSERPMPRLEPTFEIDEEEEEEDENELFPREYFRRLSSQDVLRCQSSSKRKSKDEEEDEESDDADDTPILKPVSLLRKRDVKNSPLEPDTSTPLKKKKGWPKGKSRKPIHWKKRPGRKPGFKLSREIMPVSTQACVIEPIVSIPKAGRKPKIQESEETVEPKEDMPLPEERKEEEEMQAEAEEAEEGEEEDAASSEVPAASPADSSNSPETETKEPEVEEEEEKPRVSEEQRQSEEEQQELEEPEPEEEEDAAAETAQNDDHDADDEDDGHLESTKKKELEEQPTREDVKEEPGVQESFLDANMQKSREKIKDKEETELDSEEEQPSHDTSVVSEQMAGSEDDHEEDSHTKEELIELKEEEEIPHSELDLETVQAVQSLTQEESSEHEGAYQDCEETLAACQTLQSYTQADEDPQMSMVEDCHASEHNSPISSVQSHPSQSVRSVSSPNVPALESGYTQISPEQGSLSAPSMQNMETSPMMDVPSVSDHSQQVVDSGFSDLGSIESTTENYENPSSYDSTMGGSICGNSSSQSSCSYGGLSSSSSLTQSSCVVTQQMASMGSSCSMMQQSSVQPAANCSIKSPQSCVVERPPSNQQQQPPPPPPQQPQPPPPQPQPAPQPPPPQQQPQQQPQPQPQQPPPPPPPQQQPPLSQCSMNNSFTPAPMIMEIPESGSTGNISIYERIPGDFGAGSYSQPSATFSLAKLQQLTNTIMDPHAMPYSHSPAVTSYATSVSLSNTGLAQLAPSHPLAGTPQAQATMTPPPNLASTTMNLTSPLLQCNMSATNIGIPHTQRLQGQMPVKGHISIRSKSAPLPSAAAHQQQLYGRSPSAVAMQAGPRALAVQRGMNMGVNLMPTPAYNVNSMNMNTLNAMNSYRMTQPMMNSSYHSNPAYMNQTAQYPMQMQMGMMGSQAYTQQPMQPNPHGNMMYTGPSHHSYMNAAGVPKQSLNGPYMRR

SEQ ID NO: 798655 - protein, 1868 aa, Homo sapiens
VSRFDTSRIPQDENIKRAIGHGRLLKDGPLYRLNTKATNVDGKESCESLSCLPPVSLLPHEKDKPVAEPIPICSFCLGTKEQNREKKPEELISCADCGNSGHPSCLKFSPELTVRVKALRWQCIECKTCSSCRDQGKNADNMLFCDSCDRGFHMECCDPPLTRMPKGMWICQICRPRKKGRKLLQKKAAQIKRRYTNPIGRPKNRLKKQNTVSKGPFSKVRTGPGRGRKRKITLSSQSASSSSEEGYLERIDGLDFCRDSNVSLKFNKKTKGLIDGLTKFFTPSPDGRKARGEVVDYSEQYRIRKRGNRKSSTSDWPTDNQDGWDGKQENEERLFGSQEIMTEKDMELFRDIQEQALQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVGKSVSHENKEQDSYSVESEKKPEVMAPVSSTRLSKQVLPHDSLPANSQPSRRGRWGRKNRKTQERFGDKDSKLLLEETSSAPQEQYGECGEKSEATQEQYTESEEQLVASEEQPSQDGKPDLPKRRLSEGVEPWRGQLKKSPEALKCRLTEGSERLPRRYSEGDRAVLRGFSESSEEEEEPESPRSSSPPILTKPTLKRKKPFLHRRRRVRKRKHHNSSVVTETISETTEVLDEPFEDSDSERPMPRLEPTFEIDEEEEEEDENELFPREYFRRLSSQDVLRCQSSSKRKSKDEEEDEESDDADDTPILKPVSLLRKRDVKNSPLEPDTSTPLKKKKGWPKGKSRKPIHWKKRPGRKPGFKLSREIMPVSTQACVIEPIVSIPKAGRKPKIQESEETVEPKEDMPLPEERKEEEEMQAEAEEAEEGEEEDAASSEVPAASPADSSNSPETETKEPEVEEEEEKPRVSEEQRQSEEEQQELEEPEPEEEEDAAAETAQNDDHDADDEDDGHLESTKKKELEEQPTREDVKEEPGVQESFLDANMQKSREKIKDKEETELDSEEEQPSHDTSVVSEQMAGSEDDHEEDSHTKEELIELKEEEEIPHSELDLETVQAVQSLTQEESSEHEGAYQDCEETLAACQTLQSYTQADEDPQMSMVEDCHASEHNSPISSVQSHPSQSVRSVSSPNVPALESGYTQISPEQGSLSAPSMQNMETSPMMDVPSVSDHSQQVVDSGFSDLGSIESTTENYENPSSYDSTMGGSICGNSSSQSSCSYGGLSSSSSLTQSSCVVTQQMASMGSSCSMMQQSSVQPAANCSIKSPQSCVVERPPSNQQQQPPPPPPQQPQPPPPQPQPAPQPPPPQQQPQQQPQPQPQQPPPPPPPQQQPPLSQCSMNNSFTPAPMIMEIPESGSTGNISIYERIPGDFGAGSYSQPSATFSLAKLQQLTNTIMDPHAMPYSHSPAVTSYATSVSLSNTGLAQLAPSHPLAGTPQAQATMTPPPNLASTTMNLTSPLLQCNMSATNIGIPHTQRLQGQMPVKGHISIRSKSAPLPSAAAHQQQLYGRSPSAVAMQAGPRALAVQRGMNMGVNLMPTPAYNVNSMNMNTLNAMNSYRMTQPMMNSSYHSNPAYMNQTAQYPMQMQMGMMGSQAYTQQPMQPNPHGNMMYTGPSHHSYMNAAGVPKQSLNGPYMRR

SEQ ID NO: 798656 - protein, 1334 aa, Homo sapiens
EDPVSSPFVEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVGKSVSHENKEQDSYSVESEKKPEVMAPVSSTRLSKQVLPHDSLPANSQPSRRGRWGRKNRKTQERFGDKDSKLLLEETSSAPQEQYGECGEKSEATQEQYTESEEQLVASEEQPSQDGKPDLPKRRLSEGVEPWRGQLKKSPEALKCRLTEGSERLPRRYSEGDRAVLRGFSESSEEEEEPESPRSSSPPILTKPTLKRKKPFLHRRRRVRKRKHHNSSVVTETISETTEVLDEPFEDSDSERPMPRLEPTFEIDEEEEEEDENELFPREYFRRLSSQDVLRCQSSSKRKSKDEEEDEESDDADDTPILKPVSLLRKRDVKNSPLEPDTSTPLKKKKGWPKGKSRKPIHWKKRPGRKPGFKLSREIMPVSTQACVIEPIVSIPKAGRKPKIQESEETVEPKEDMPLPEERKEEEEMQAEAEEAEEGEEEDAASSEVPAASPADSSNSPETETKEPEVEEEEEKPRVSEEQRQSEEEQQELEEPEPEEEEDAAAETAQNDDHDADDEDDGHLESTKKKELEEQPTREDVKEEPGVQESFLDANMQKSREKIKDKEETELDSEEEQPSHDTSVVSEQMAGSEDDHEEDSHTKEELIELKEEEEIPHSELDLETVQAVQSLTQEESSEHEGAYQDCEETLAACQTLQSYTQADEDPQMSMVEDCHASEHNSPISSVQSHPSQSVRSVSSPNVPALESGYTQISPEQGSLSAPSMQNMETSPMMDVPSVSDHSQQVVDSGFSDLGSIESTTENYENPSSYDSTMGGSICGNSSSQSSCSYGGLSSSSSLTQSSCVVTQQMASMGSSCSMMQQSSVQPAANCSIKSPQSCVVERPPSNQQQQPPPPPPQQPQPPPPQPQPAPQPPPPQQQPQQQPQPQPQQPPPPPPPQQQPPLSQCSMNNSFTPAPMIMEIPESGSTGNISIYERIPGDFGAGSYSQPSATFSLAKLQQLTNTIMDPHAMPYSHSPAVTSYATSVSLSNTGLAQLAPSHPLAGTPQAQATMTPPPNLASTTMNLTSPLLQCNMSATNIGIPHTQRLQGQMPVKGHISIRSKSAPLPSAAAHQQQLYGRSPSAVAMQAGPRALAVQRGMNMGVNLMPTPAYNVNSMNMNTLNAMNSYRMTQPMMNSSYHSNPAYMNQTAQYPMQMQMGMMGSQAYTQQPMQPNPHGNMMYTGPSHHSYMNAAGVPKQSLNGPYMRR

SEQ ID NO: 798657 - protein, 446 aa, Homo sapiens
TQGELQLASDVYLTGASCICGNSSSQSSCSYGGLSSSSSLTQSSCVVTQQMASMGSSCSMMQQSSVQPAANCSIKSPQSCVVERPPSNQQQQPPPPPPQQPQPPPPQPQPAPQPPPPQQQPQQQPQPQPQQPPPPPPPQQQPPLSQCSMNNSFTPAPMIMEIPESGSTGNISIYERIPGDFGAGSYSQPSATFSLAKLQQLTNTIMDPHAMPYSHSPAVTSYATSVSLSNTGLAQLAPSHPLAGTPQAQATMTPPPNLASTTMNLTSPLLQCNMSATNIGIPHTQRLQGQMPVKGHISIRSKSAPLPSAAAHQQQLYGRSPSAVAMQAGPRALAVQRGMNMGVNLMPTPAYNVNSMNMNTLNAMNSYRMTQPMMNSSYHSNPAYMNQTAQYPMQMQMGMMGSQAYTQQPMQPNPHGNMMYTGPSHHSYMNAAGVPKQSLNGPYMRR

SEQ ID NO: 798658 - protein, 1303 aa, Homo sapiens
MVKLANPLYTEWILEAIKKVKKQKQRPSEERICNAVSSSHGLDRKTVLEQLELSVKDGTILKVSNKGLNSYKDPDNPGRIALPKPRNHGKLDNKQNVDWNKLIKRAVEGLAESGGSTLKSIERFLKGQKDVSALFGGSAASGFHQQLRLAIKRAIGHGRLLKDGPLYRLNTKATNVDGKESCESLSCLPPVSLLPHEKDKPVAEPIPICSFCLGTKEQNREKKPEELISCADCGNSGHPSCLKFSPELTVRVKALRWQCIECKTCSSCRDQGKNADNMLFCDSCDRGFHMECCDPPLTRMPKGMWICQICRPRKKGRKLLQKKAAQIKRRYTNPIGRPKNRLKKQNTVSKGPFSKVRTGPGRGRKRKITLSSQSASSSSEEGYLERIDGLDFCRDSNVSLKFNKKTKGLIDGLTKFFTPSPDGRKARGEVVDYSEQYRIRKRGNRKSSTSDWPTDNQDGWDGKQENEERLFGSQEIMTEKDMELFRDIQEQALQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVGKSVSHENKEQDSYSVESEKKPEVMAPVSSTRLSKQVLPHDSLPANSQPSRRGRWGRKNRKTQERFGDKDSKLLLEETSSAPQEQYGECGEKSEATQEQYTESEEQLVASEEQPSQDGKPDLPKRRLSEGVEPWRGQLKKSPEALKCRLTEGSERLPRRYSEGDRAVLRGFSESSEEEEEPESPRSSSPPILTKPTLKRKKPFLHRRRRVRKRKHHNSSVVTETISETTEVLDEPFEDSDSERPMPRLEPTFEIDEEEEEEDENELFPREYFRRLSSQDVLRCQSSSKRKSKDEEEDEESDDADDTPILKPVSLLRKRDVKNSPLEPDTSTPLKKKKGWPKGKSRKPIHWKKRPGRKPGFKLSREIMPVSTQACVIEPIVSIPKAGRKPKIQESEETVEPKEDMPLPEERKEEEEMQAEAEEAEEGEEEDAASSEVPAASPADSSNSPETETKEPEVEEEEEKPRVSEEQRQSEEEQQELESRPVVGPAH

SEQ ID NO: 798659 - protein, 906 aa, Homo sapiens
MVKLANPLYTEWILEAIKKVKKQKQRPSEERICNAVSSSHGLDRKTVLEQLELSVKDGTILKVSNKGLNSYKDPDNPGRIALPKPRNHGKLDNKQNVDWNKLIKRAVEGLAESGGSTLKSIERFLKGQKDVSALFGGSAASGFHQQLRLAIKRAIGHGRLLKDGPLYRLNTKATNVDGKESCESLSCLPPVSLLPHEKDKPVAEPIPICSFCLGTKEQNREKKPEELISCADCGNSGHPSCLKFSPELTVRVKALRWQCIECKTCSSCRDQGKNADNMLFCDSCDRGFHMECCDPPLTRMPKGMWICQICRPRKKGRKLLQKKAAQIKRRYTNPIGRPKNRLKKQNTVSKGPFSKVRTGPGRGRKRKITLSSQSASSSSEEGYLERIDGLDFCRDSNVSLKFNKKTKGLIDGLTKFFTPSPDGRKARGEVVDYSEQYRIRKRGNRKSSTSDWPTDNQDGWDGKQENEERLFGSQEIMTEKDMELFRDIQEQALQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVGKSVSHENKEQDSYSVESEKKPEVMAPVSSTRLSKQVLPHDSLPANSQPSRRGRWGRKNRKTQERFGDKDSKLLLEETSSAPQEQYDSEDKRA

SEQ ID NO: 798660 - protein, 1953 aa, Homo sapiens
MVKLANPLYTEWILEAIKKVKKQKQRPSEERICNAVSSSHGLDRKTVLEQLELSVKDGTILKVSNKGLNSYKDPDNPGRIALPKPRNHGKLDNKQNVDWNKLIKRAVEGLAESGGSTLKSIERFLKGQKDVSALFGGSAASGFHQQLRLAIKRAIGHGRLLKDGPLYRLNTKATNVDGKESCESLSCLPPVSLLPHEKDKPVAEPIPICSFCLGTKEQNREKKPEELISCADCGNSGHPSCLKFSPELTVRVKALRWQCIECKTCSSCRDQGKNADNMLFCDSCDRGFHMECCDPPLTRMPKGMWICQICRPRKKGRKLLQKKAAQIKRRYTNPIGRPKNRLKKQNTVSKGPFSKVRTGPGRGRKRKITLSSQSASSSSEEGYLERIDGLDFCRDSNVSLKFNKKTKGLIDGLTKFFTPSPDGRKARGEVVDYSEQYRIRKRGNRKSSTSDWPTDNQDGWDGKQENEERLFGSQEIMTEKDMELFRDIQEQALQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVGKSVSHENKEQDSYSVESEKKPEVMAPVSSTRLSKQVLPHDSLPANSQPSRRGRWGRKNRKTQERFGDKDSKLLLEETSSAPQEQYGECGEKSEATQEQYTESEEQLVASEEQPSQDGKPDLPKRRLSEGVEPWRGQLKKSPEALKCRLTEGSERLPRRYSEGDRAVLRGFSESSEEEEEPESPRSSSPPILTKPTLKRKKPFLHRRRRVRKRKHHNSSVVTETISETTEVLDEPFEDSDSERPMPRLEPTFEIDEEEEEEDENELFPREYFRRLSSQDVLRCQSSSKRKSKDEEEDEESDDADDTPILKPVSLLRKRDVKNSPLEPDTSTPLKKKKGWPKGKSRKPIHWKKRPGRKPGFKLSREIMPVSTQACVIEPIVSIPKAGRKPKIQESEETVEPKEDMPLPEERKEEEEMQAEAEEAEEGEEEDAASSEVPAASPADSSNSPETETKEPEVEEEEEKPRVSEEQRQSEEEQQELEEPEPEEEEDAAAETAQNDDHDADDEDDGHLESTKKKELEEQPTREDVKEEPGVQESFLDANMQKSREKIKDKEETELDSEEEQPSHDTSVVSEQMAGSEDDHEEDSHTKEELIELKEEEEIPHSELDLETVQAVQSLTQEESSEHEGAYQDCEETLAACQTLQSYTQADEDPQMSMVEDCHASEHNSPISSVQSHPSQSVRSVSSPNVPALESGYTQISPEQGSLSAPSMQNMETSPMMDVPSVSDHSQQVVDSGFSDLGSIESTTENYENPSSYDSTMGGSICGNSSSQSSCSYGGLSSSSSLTQSSCVVTQQMASMGSSCSMMQQSSVQPAANCSIKSPQSCVVERPPSNQQQQPPPPPPQQPQPPPPQPQPAPQPPPPQQQPQQQPQPQPQQPPPPPPPQQQPPLSQCSMNNSFTPAPMIMEIPESGSTGNISIYERIPGDFGAGSYSQPSATFSLAKLQQLTNTIMDPHAMPYSHSPAVTSYATSVSLSNTGLAQLAPSHPLAGTPQAQATMTPPPNLASTTMNLTSPLLQCNMSATNIGIPHTQRLQGQMPVKGHISIRSKSAPLPSAAAHQQQLYGRSPSAVAMQAGPRALAVQRGMNMGVNLMPTPAYNVNSMNMNTLNAMNSYRMTQPMMNSSYHSNPAYMNQTPETRRAT

SEQ ID NO: 798661 - protein, 520 aa, Homo sapiens [sequence omitted]

SEQ ID NO: 798662 - protein, 107 aa, Homo sapiens
MAHSQNSLELPININATQITTAYGHRALPKLKEELQSEDLQTRQKALMALCDLMHDPECIYKAMNIGCMENLKALLKDSNSMVRIKTTEVLHITASHSVGSSDRKGE

SEQ ID NO: 798663 - protein, 348 aa, Homo sapiens
MAHSQNSLELPININATQITTAYGHRALPKLKEELQSEDLQTRQKALMALCDLMHDPECIYKAMNIGCMENLKALLKDSNSMVRIKTTEVLHITASHSVGRYAFLEHDIVLALSFLLNDPSPVCRGNLYKAYMQLVQVPRGAQEIISKGLISSLVWKLQVEVEEEEFQEFILDTLVLCLQEDATEALGSNVVLVLKQKLLSANQNIRSKAARALLNVSISREGKKQVCHFDVIPILVHLLKDPVEHVKSNAAGALMFATVITEGKYAALEAQAIGLLLELLHSPMTIARLNATKALTMLAEAPEGRKALQTHVPTFRAMEVETYEKPQVAEALQRAARIAISVIEFKP

SEQ ID NO: 798664 - protein, 197 aa, Homo sapiens
MAHSQNSLELPININATQITTAYGHRALPKLKEELQSEDLQTRQKALMALCDLMHDPECIYKAMNIGCMENLKALLKDSNSMVRIKTTEVLHITASHSVGRYAFLEHDIVLALSFLLNDPSPVCRGNLYKAYMQLVQVPRAENPTINKRTLQRLMYNTCPARLAQDCHSLQNFFGAERQIVQITTFTLSKPDTKKTT

SEQ ID NO: 798665 - protein, 166 aa, Homo sapiens
MIQLKPSPFSLLCDLACVCAENEKADQSYRCCENIAKQNLGCCPHLSVPAPSQRSQPPLAVPGLLYLRKVEGAHVLAQEEAVQRDRPDQEEELLHRLPHKLGVQAVLAHGGVKVAQLLQDGGHGVAVRVVYARGALPEACGLQAGNALQALILQHSRNCGETGRLC

SEQ ID NO: 798666 - protein, 365 aa, Homo sapiens
MGPCSGSRLGPPEAESPSQPPKRRKKRYLRHDKPPYTYLAMIALVIQAAPSRRLKLAQIIRQVQAVFPFFREDYEGWKDSIRHNLSSNRCFRKVPKDPAKPQAKGNFWAVDVSLIPAEALRLQNTALCRRWQNGGARGAFAKDLGPYVLHGRPYRPPSPPPPPSEGFSIKSLLGGSGEGAPWPGLAPQSSPVPAGTGNSGEEAVPTPPLPSSERPLWPLCPLPGPTRVEGETVQGGAIGPSTLSPEPRAWPLHLLQGTAVPGGRSSGGHRASLWGQLPTSYLPIYTPNVVMPLAPPPTSCPQCPSTSPAYWGVAPETRGPPGLLCDLDALFQGVPPNKSIYDVWVSHPRDLAAPGPGWLLSWCSL

SEQ ID NO: 798667 - protein, 267 aa, Homo sapiens
MGPCSGSRLGPPEAESPSQPPKRRKKRYLRHDKPPYTYLAMIALVIQAAPSRRLKLAQIIRQVQAVFPFFREDYEGWKDSIRHNLSSNRCFRKVPKDPAKPQAKGNFWAVDVSLIPAEALRLQNTALCRRWQNGGARGAFAKDLGPYVLHGRPYRPPSPPPPPSEGFSIKSLLGGSGEGAPWPGLAPQSSPVPAGTGNSGEEAVPTPPLPSSERPLWPLCPLPGPTRVEGETVLGEGEPSGGSSLKSCPLSSVWKGGSTFFGKRVRE

SEQ ID NO: 798668 - protein, 365 aa, Homo sapiens; identical to SEQ ID NO: 798666

SEQ ID NO: 798669 - protein, 69 aa, Homo sapiens
VDTARGPRSRRLIGALPGLPSWAMDPSEAIRLCSSLALLDPSGWLGCSSSVCIDWSWDRSPHSRNRTRR

SEQ ID NO: 798670 - protein, 202 aa, Homo sapiens [sequence omitted]

SEQ ID NO: 798671 - protein, 538 aa, Homo sapiens
MTTPGKENFRLKSYKNKSLNPDEMRRRREEEGLQLRKQKREEQLFKRRNVATAEEETEEEVMSDGGFHEAQINNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIFIELLSSEFEDVQEQAVWALGNIAGDSTMCRDYVLDCNILPPLLQLFSKQNRLTMTRNAVWALSNLCRGKSPPPEFAKVSPCLNVLSWLLFVSDTDVLADACWALSYLSDGPNDKIQAVIDAGVCRRLVELLMHNDYKVVSPALRAVGNIVTGDDIQTQVILNCSALQSLLHLLSSPKESIKKEACWTISNITAGNRAQIQTVIDANIFPALISILQTAEFRTRKEAAWAITNATSGGSAEQIKYLVELGCIKPLCDLLTVMDSKIVQVALNGLENILRLGEQEAKRNGTGINPYCALIEEAYGLDKIEFLQSHENQEIYQKAFDLIEHYFGTEDEDSSIAPQVDLNQQQYIFQQCEAPMEGFQL

SEQ ID NO: 798672 - protein, 538 aa, Homo sapiens; identical to SEQ ID NO: 798671

SEQ ID NO: 798673 - protein, 538 aa, Homo sapiens; identical to SEQ ID NO: 798671

SEQ ID NO: 798674 - protein, 118 aa, Homo sapiens
MKTRRSTKRPLILLSITSGPKMKTAALHPRLTLTSSSTSSNSVRLLWKVSSFEAILCFHVPVSDQATQSSPLVEPTVLMELTSQMFSIILFALICLPCAPALLHTSGKPPALCGGIPF

SEQ ID NO: 798675 - protein, 538 aa, Homo sapiens; identical to SEQ ID NO: 798671

SEQ ID NO: 798676 - protein, 538 aa, Homo sapiens; identical to SEQ ID NO: 798671

SEQ ID NO: 798677 - protein, 142 aa, Homo sapiens
RSPGVIAIGNAGEARRGGAAWRGGGPEIMTTPGKENFRLKSYKNKSLNPDEMRRRREEEGLQLRKQKREEQLFKRRNVATAEEETEEEVMSDGGFHEAQITNFSNVFHNTVCAHLLALRTCSLTHIWKTSGSLWWNTLLIKG

SEQ ID NO: 798678 - protein, 494 aa, Homo sapiens
MTTPGKENFRLKSYKNKSLNPDEMRRRREEEGLQLRKQKREEQLFKRRNVATAEEETEEEVMSDGGFHEAQINNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIFIELLSSEFEDVQEQAVWALGNIAGDSTMCRDYVLDCNILPPLLQLFSKQNRLTMTRNAVWALSNLCRGKSPPPEFAKVSPCLNVLSWLLFVSDTDVLADACWALSYLSDGPNDKIQAVIDAGVCRRLVELLMHNDYKVVSPALRAVGNIVTGDDIQTQVILNCSALQSLLHLLSSPKESIKKEACWTISNITAGNRAQIQTVIDANIFPALISILQTAEFRTRKEAAWAITNATSGGSAEQIKYLVELGCIKPLCDLLTVMDSKIVQVALNGLENILRLGEQEAKRNGTGINPYCALIEEAYGKMLWLKKFMAKNELGHR

SEQ ID NO: 798679 - protein, 127 aa, Homo sapiens
EVSLAFARNQSGTGKVVSNRVLIQMEKGNQAYLNLNGKLDEEFESAWVLTNIASGNSLQTRIVIQAGAVPIFIELLSSEFEDVQEQAVWALGNIAGDSTMCRDYVLDCNILPPLLQLFSKRGKGPPP

SEQ ID NO: 798680 - protein, 538 aa, Homo sapiens; identical to SEQ ID NO: 798671

SEQ ID NO: 798681 - protein, 538 aa, Homo sapiens; identical to SEQ ID NO: 798671

SEQ ID NO: 798682 - protein, 333 aa, Homo sapiens
MTTPGKENFRLKSYKNKSLNPDEMRRRREEEGLQLRKQKREEQLFKRRNVATAEEETEEEVMSDGGFHEAQINNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIFIELLSSEFEDVQEQAVWALGNIAGDSTMCRDYVLDCNILPPLLQLFSKQNRLTMTRNAVWALSNLCRGKSPPPEFAKVSPCLNVLSWLLFVSDTDVLADACWALSYLSDGPNDKIQAVIDAGVCRRLVELLMHNDYKVVSPALRAVGNIVTGDDIQTQV

SEQ ID NO: 798683 - protein, 345 aa, Homo sapiens
MTTPGKENFRLKSYKNKSLNPDEMRRRREEEGLQLRKQKREEQLFKRRNVATAEEETEEEVMSDGGFHEAQINNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIFIELLSSEFEDVQEQAVWALGNIAGDSTMCRDYVLDCNILPPLLQLFSKQNRLTMTRNAVWALSNLCRGKSPPPEFAKVSPCLNVLSWLLFVSDTDVLADACWALSYLSDGPNDKIQAVIDAGVCRRLVELLMHNDYIVVDTLHSTFTSVWDNVTFINIFALLSHRIPRISV

SEQ ID NO: 798684 - protein, 373 aa, Homo sapiens
MTTPGKENFRLKSYKNKSLNPDEMRRRREEEGLQLRKQKREEQLFKRRNVATAEEETEEEVMSDGGFHEAQINNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIFIELLSSEFEDVQEQAVWALGNIAGDSTMCRDYVLDCNILPPLLQLFSKQNRLTMTRNAVWALSNLCRGKSPPPEFAKVSPCLNVLSWLLFVSDTDVLADACWALSYLSDGPNDKIQAVIDAGVCRRLVELLMHNDYKVVSPALRAVGNIVTGDDIQTQVILNCSALQSLLHLLSSPKESIKKEACWHLSQSGSVPYFQL

SEQ ID NO: 798685 - protein, 67 aa, Homo sapiens
MTPISKLSSTSKLYRLPRFQMPNSRIFSIKFVPLPTVVQKTSTLIFPQCLFQREARLSRLPAQRFST

SEQ ID NO: 798686 - protein, 103 aa, Homo sapiens
SKSKKTARTRLSPIAPAAGANRSLATAACACARRTAQRDVGGAAKSPDHLPARVEFPRSVSFPAPPRKVRSRETPRMKSGSVAQAGVCWHHLGSLQLPPPRLQ

SEQ ID NO: 798687 - protein, 136 aa, Homo sapiens
SPGNVCRRRRMRRLLSGCGWRWSEAWCSSLVSFCLSLSSLGPPARGTVITSPREVVRAARRWAAGSPGGRAGGAETSAGLMSALSARGPSLPNGTIVVRMLMPSVEPVVSYIRGSSPGPSQLPPLCKFITTERPQG

SEQ ID NO: 798688 - protein, 104 aa, Homo sapiens
TSTQLPPALSVVCWIPPLLRGIFQQFFPPWFCIFKVLPPFESTPFSISLTPLHRNYSCQATNDLHLALQSPFPGLFLFVLSVAFELASHCFLLDKLFFFSFCFS

SEQ ID NO: 798689 - protein, 107 aa, Homo sapiens
SPGNVCRRRRMRRLLSGCGWRWSEAWCSSLVSFCLSLSSLGPPARGTVITSPREVVRAARRWAAGSPGGRAGGAETSAGLMSALSARGPSLPVRAGHCRMAPLLCGC

SEQ ID NO: 798690 - protein, 120 aa, Homo sapiens
SKSKKTARTRLSPIAPAAGANRSLATAACACARRTAQRDVGGAAKSPDHLPARVEFPRSVSFPAPPRKVRSRETPRNGTIVVRMLMPSVEPVVSYIRGSSPGPSQLPPLCKFITTERPQG

SEQ ID NO: 798691 - protein, 216 aa, Homo sapiens
MSHQSFCARDKACTHILCGKNCSQSVHSPHKPALKLEKVSQCPECGKTFSRSSYLVRHQRIHTGEKPHKCSECGKGFSERSNLTAHLRTHTGERPYQCGQCGKSFNQSSSLIVHQRTHTGEKPYQCIVCGKRFNNSSQFSAHRRIHTGESPYKCAVCGKIFNNSSHFSAHRKTHTGEKPYRCSHCERGFTKNSALTRHQTVHMKAVLSSQEGRDAL

SEQ ID NO: 798692 - protein, 696 aa, Homo sapiens [sequence omitted]

SEQ ID NO: 798693 - protein, 567 aa, Homo sapiens
MAAVKSTEAHPSSNKDPTQGQKSALQGNSPDSEASRQRFRQFCYQEVTGPHEAFSKLWELCCQWLRPKTHSKEEILELLVLEQFLTILPEEIQTWVREQHPENGEEAVALVEDVQRAPGQQQQVPWGYEETKTLLAILSSSQFYGKLQTCQQNSQIYRAMAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGFEFKNEIKKENLKWDDSEEVEINKALQRKSRGVYWHSELQKGLESEPTSRRQCRNSPGESEEKTPSQEKMSHQSFCARDKACTHILCGKNCSQSVHSPHKPALKLEKVSQCPECGKTFSRSSYLVRHQRIHTGEKPHKCSECGKGFSERSNLTAHLRTHTGERPYQCGQCGKSFNQSSSLIVHQRTHTGEKPYQCIVCGKRFNNSSQFSAHRRIHTGESPYKCAVCGKIFNNSSHFSAHRKTHTGEKPYRCSHCERGFTKNSALTRHQTVHMKAVLSSQEGRDAL

SEQ ID NO: 798694 - protein, 641 aa, Homo sapiens
MAAVKSTEAHPSSNKDPTQGQKSALQGNSPDSEASRQRFRQFCYQEVTGPHEAFSKLWELCCQWLRPKTHSKEEILELLVLEQFLTILPEEIQTWVREQHPENGEEAVALVEDVQRAPGQQPGLLLRLPGTCLKTQVSTTRRQVLWSGQLGPRDQPCVTTELYPSVSKNGCAQALHKGPSTGVPPREKDSHVSLATGVPWGYEETKTLLAILSSSQFYGKLQTCQQNSQIYRAMAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGFEFKNEIKKENLKWDDSEEVEINKALQRKSRGVYWHSELQKGLESEPTSRRQCRNSPGESEEKTPSQEKMSHQSFCARDKACTHILCGKNCSQSVHSPHKPALKLEKVSQCPECGKTFSRSSYLVRHQRIHTGEKPHKCSECGKGFSERSNLTAHLRTHTGERPYQCGQCGKSFNQSSSLIVHQRTHTGEKPYQCIVCGKRFNNSSQFSAHRRIHTGESPYKCAVCGKIFNNSSHFSAHRKTHTGEKPYRCSHCERGFTKNSALTRHQTVHMKAVLSSQEGRDAL

SEQ ID NO: 798695 - protein, 138 aa, Homo sapiens
MAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGKTPLALMVKGWQSPL

SEQ ID NO: 798696 - protein, 696 aa, Homo sapiens [sequence omitted]

SEQ ID NO: 798697 - protein, 185 aa, Homo sapiens [sequence omitted]

SEQ ID NO: 798698 - protein, 1211 aa, Homo sapiens
VGAGAAAAVVVLAGAGAAGWRSGGRAGGLAGRTSGRRLKDQRDFGDQRRAWGDLGLGACEISLAFAGSSRRDRPMAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVHARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 798699 - protein, 1211 aa, Homo sapiens; identical to SEQ ID NO: 798698

SEQ ID NO: 798700 - protein, 1211 aa, Homo sapiens; identical to SEQ ID NO: 798698

SEQ ID NO: 798701 - protein, 1205 aa, Homo sapiens
VGAGAAAAVVVLAGAGAAGWRSGGRAGGLAGRTSGRRLKDQRDFGDQRRAWGDLGLGACEISLAFAGSSRRDRPMAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVHARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 798702 - protein, 448 aa, Homo sapiens [sequence omitted]

SEQ ID NO: 798703 - protein, 1249 aa, Homo sapiens
VGAGAAAAVVVLAGAGAAGWRSGGRAGGLAGRTSGRRLKDQRDFGDQRRAWGDLGLGACEISLAFAGSSRRDRPMAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVHARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKCGFFHRSSQSSSFPTNYHRACLAVQPSAMEVGGPGTVEMGFFKRAKHPEATVPQYHAVKIPREDRQQFKEEKTGTILRNNWGSPRREGPDAHPILAADGHPELGPDGHPGPGTA

SEQ ID NO: 798704 - protein, 882 aa, Homo sapiens
MEERANVVGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVHARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 798705 - protein, 384 aa, Homo sapiens [sequence omitted]

SEQ ID NO: 798706 - protein, 109 aa, Homo sapiens [sequence omitted]

SEQ ID NO: 798707 - protein, 101 aa, Homo sapiens
AEGHLKPHLPMILLMETHNRLWSGLSLWGAMSALCINTEGDKHYVDADRGCRDLTVPWGPDCTHHPHHHVGEGCDPQRGGSKRHHEPFLPARLVAVGYSEV

SEQ ID NO: 798708 - protein, 76 aa, Homo sapiens
YPHPHTTFEVGTAMMDAHFTDVETEVLTGKVTWPKSHRDEVSLDLNAGQAPPRQVPHHLLWGKAALTWAAPGGFYP

SEQ ID NO: 798709 - protein, 128 aa, Homo sapiens
YPHPHTTFEVGTAMMDAHFTDVETEVLTGKVTWPKSHRDEVSLDLNAVDARTNGQARGGGGDDASRTPAGHASLDRDWNTDPHTRSLDRRYTDRGTYGYSQAPPRQVPHHLLWGKAALTWAAPGGFYP

SEQ ID NO: 798710 - protein, 706 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 798711 - protein, 650 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 798712 - protein, 706 aa, Homo sapiens; identical to SEQ ID NO: 798710

SEQ ID NO: 798713 - protein, 389 aa, Homo sapiens
TLEDPLCSQISGSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 798714 - protein, 706 aa, Homo sapiens; identical to SEQ ID NO: 798710

SEQ ID NO: 798715 - protein, 105 aa, Homo sapiens
GSFTCEYQRGFSLDQTGSSCEDVDECEGYHRCPHGCQYIIGGYRCSCPQAHWQQHSGKQGTDICTTLAYLSAEARMHMGSSPGLGEARAAPVPRRENLPLWVFEQ

SEQ ID NO: 798716 - protein, 706 aa, Homo sapiens; identical to SEQ ID NO: 798710

SEQ ID NO: 798717 - protein, 591 aa, Homo sapiens [sequence omitted]

SEQ ID NO: 798718 - protein, 67 aa, Homo sapiens
GPSSLEPEPPNPRRSAYEDLEICRPVKKSCGFEGFWLARGSKNLGELTPSPPLPRSSGKVRSSNSEN

SEQ ID NO: 798719 - protein, 706 aa, Homo sapiens; identical to SEQ ID NO: 798710

SEQ ID NO: 798720 - protein, 706 aa, Homo sapiens; identical to SEQ ID NO: 798710

SEQ ID NO: 798721 - protein, 617 aa, Homo sapiens
MYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 798722 - protein, 319 aa, Homo sapiens
MSGCLWPTPSPRSGHSHVIVPGQSLVSTPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 798723 - protein, 165 aa, Homo sapiens
SDPTAGCTGPTFPEEMGETQSEYSDSSCGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 798724 - protein, 148 aa, Homo sapiens
MAFLFPFFLVIGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 798725 - protein, 721 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPEHPILRHACVITTPETGFGCV

SEQ ID NO: 798726 - protein, 668 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHVRKPLEAAL

SEQ ID NO: 798727 - protein, 227 aa, Homo sapiens
MPLGPVGTLCSQEPGRLTAEPRGLGLPRPSIQARLSRSWESVPTASPASRSTEEKSRGQSRKKPSSEPTAHMAGETLRLLMAMPGPGGREASVPRCPCHPGHVVGALLPELKVCFCGWGPPGVRVGSRRRACRTTMRCQSISKMWPLRLHTKLPEEAAGKSTGQERSTPPRSRQSRTLPCPHDAILQGMRTEHCRSSQRPDPPGDAETHSQARGRCSGLGPHSGPRP

SEQ ID NO: 798728 - protein, 103 aa, Homo sapiens
STVTCHVSHLTGNKSLSVKFEFRSQNLRISSVVLTDHSLCETLSFCGHSGHHRICFLPEDKSCQVGKKFFKEEGRVFFCFSSLSLDCNIGEMSDGPAVNLGHG

SEQ ID NO: 798729 - protein, 102 aa, Homo sapiens
MAQDFSQHPQTGIIRRHRFYSPKPLSTTPRGQSFLLSRQAKVATWDPMLSPDFQPKSAFKLTWTAQPPCLSVTPSQGQTFHPNSPEGELPPDLTENTCPSQA

SEQ ID NO: 798730 - protein, 468 aa, Homo sapiens
MIPRHPPSICSQEVEETVSTVDSGAPTDLAQLPTVLKQPCCSVMASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLEDIKVVLCRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCEVPSS

SEQ ID NO: 798731 - protein, 267 aa, Homo sapiens
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLENWRKNSVKQNQDTTPSQGA

SEQ ID NO: 798732 - protein, 114 aa, Homo sapiens
MNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCEVPSS

SEQ ID NO: 798733 - protein, 97 aa, Homo sapiens
RSPTTVRAAPLFARSLMQRLSGLSAHETHHSTWASSQCRAVLFPPQGGPLESPHRLLRIRHSPSNPMSPTTLALPYIPTSPFSPNPSYQQGKLINEI

SEQ ID NO: 798734 - protein, 468 aa, Homo sapiens; identical to SEQ ID NO: 798730

SEQ ID NO: 798735 - protein, 365 aa, Homo sapiens
MIPRHPPGSICSQEVEETVSTVDSGAPTDLAQLPTVLKQPCCSVMASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLEDIKVVLCRSEEFQFLNPTPVPLELEKKLSEAKSRHDSITGSLKKFKDQLQADRKKDENRFFKSMNKNDMKSCK

SEQ ID NO: 798736 - protein, 425 aa, Homo sapiens
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLEDIKVVLCRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCEVPSS

SEQ ID NO: 798737 - protein, 452 aa, Homo sapiens
MIPRHPPSICSQEVEETVSTVDSGAPTDLAQLPTVLKQPCCSVMASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLEPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCEVPSS

SEQ ID NO: 798738 - protein, 311 aa, Homo sapiens
MIPRHPPGSICSQEVEETVSTVDSGAPTDLAQLPTVLKQPCCSVMASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLEDIKVVLCRYDGPPQMYFAY

SEQ ID NO: 798739 - protein, 196 aa, Homo sapiens
MASGQFVNKLQEEVICPICLDILQKPVTIDCGHNFCLKCITQIGETSCGFFKCPLCKTSVRKNAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTVRKTPSHDLWKQKHLCQSSWNPLLH

SEQ ID NO: 798740 - protein, 83 aa, Homo sapiens
RSPTTVRAAPLFARSLMQRLSGLSAHETHHSTWASSQCRAVLFPPQGGPLESPHRLLRIPPHPEDFRLPAPHLGPAHLGLLTE

SEQ ID NO: 798741 - protein, 103 aa, Homo sapiens
HQPAQPHLPRSEEFQFLNPTPVPLELEKKLSEAKSRHDSITGSLKKFKDQLQADRKKDENRFFKSMNKNDMKSWGLLQKNNHKMNKTSEPGSSSAGKSPVSEY

SEQ ID NO: 798742 - protein, 185 aa, Homo sapiens
MPPRQLLEDIKVVLCRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCEVPSS

SEQ ID NO: 798743 - protein, 144 aa, Homo sapiens
RTQQTQNTLHLPLKNSSYERENLISGSNQTELSSGISESSHFIPYVRTNEIYYLDPDAPLSGPSTQDPQYQNSQDCGQKRQLFDSDCVRDPLLNPNMVKNRDRQQAILKGLSELRQGLLQKQKELESSLLPLAENQEESFGSSF

SEQ ID NO: 798744 - protein, 117 aa, Homo sapiens
RTQQTQNTLHLPLKNSSYERENLISGSNQTELSSGISESSHFIPYVRTNEIYYLDPDAPLSGPSTQDPQYQNSQDCGQKRQLFDSDCVRDPLLNPNMVKNRDRQQAILKGLSELRQV

SEQ ID NO: 798745 - protein, 113 aa, Homo sapiens
DHNAGCILDRVSLCRPSWSAAVLSQLTAASNSRGQAILPQLPVSEVTAQSLLSNTSCETTGMKGACVISQINQHMETEKDRFKVQGVFVASCAHVRCFIYNITTAGTEKKQRQ

SEQ ID NO: 798746 - protein, 125 aa, Homo sapiens
CGALGKRKSQMKLLPGSNFTSMFNTQVCCPDLPEEAGNAHGQRDKNEDFRRKEWGWQTCRPGARAGQPQAPSGYREEANGRGCPAGSREEHEGSGGRKVLPEGRAETVRDPGSEGPMTTMAVVHR

SEQ ID NO: 798747 - protein, 453 aa, Homo sapiens
MISQFFILSSKGDPLIYKDFRGDSGGRDVAELFYRKLTGLPGDESPVVMHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQMDVPGPPGPPSHGLSTSASPLGLGPASLSFELPRHTCSGLQVRFLRLAFRPCGNANPHKWVRHLSHSDAYVIRI

SEQ ID NO: 798748 - protein, 103 aa, Homo sapiens
YPQHVCQGHEVSSQIVQQGLEVSFHSSVNLDEFESHRILRLQPPQGELTYCTAGRRVGRQPPRAGSWPAVWEQEGKDSSVYSFREWGTRTGMSWLVCFLKLRL

SEQ ID NO: 798749 - protein, 408 aa, Homo sapiens
MISQFFILSSKGDPLIYKDFRGDSGGRDVAELFYRKLTGLPGDESPVVMHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQRPNIVSQLSQACDGAITSRPGRLLVHPAL

SEQ ID NO: 798750 - protein, 354 aa, Homo sapiens
MISQFFILSSKGDPLIYKDFRGDSGGRDVAELFYRKLTGLPGDESPVVMHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQERWSRDPLD

SEQ ID NO: 798751 - protein, 325 aa, Homo sapiens
MLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQMDVPGPPGPPSHGLSTSASPLGLGPASLSFELPRHTCSGLQVRFLRLAFRPCGNANPHKWVRHLSHSDAYVIRI

SEQ ID NO: 798752 - protein, 460 aa, Homo sapiens
MISQFFILSSKGDPLIYKDFRGDSGGRDVAELFYRKLTGLPGDESPVVMVTSGGRRHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQMDVPGPPGPPSHGLSTSASPLGLGPASLSFELPRHTCSGLQVRFLRLAFRPCGNANPHKWVRHLSHSDAYVIRI

SEQ ID NO: 798753 - protein, 409 aa, Homo sapiens
MISQFFILSSKGDPLIYKDFRGDSGGRDVAELFYRKLTGLPGDESPVVMHHHGRHFIHIRHSGLYLVVTTSENDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQMDVPGPPGPPSHGLSTSASPLGLGPASLSFELPRHTCSGLQVRFLRLAFRPCGNANPHKWVRHLSHSDAYVIRI

SEQ ID NO: 798754 - protein, 244 aa, Homo sapiens
MISQFFILSSKGDPLIYKDFRGDSGGRDVAELFYRKLTGLPGDESPVVMHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSVVSDAGRTAVDQNLQTKLLF

SEQ ID NO: 798755 - protein, 32 aa, Homo sapiens
MISQFFILSSKGDPLIYKDCILDPWGWEGAEG

SEQ ID NO: 798756 - protein, 480 aa, Homo sapiens
AGTGLGCRDQAGQARLSPSSCLLSRTAMISQFFILSSKGDPLIYKDFRGDSGGRDVAELFYRKLTGLPGDESPVVMHHHGRHFIHIRHSGLYLVVTTSENVSPFSLLELLSRLATLLGDYCGSLGEGTISRNVALVYELLDEVLDYGYVQTTSTEMLRNFIQTEAVVSKPFSLFDLSSVGLFGAETQQSKVAPSSAASRPVLSSRSDQSQKNEVFLDVVERLSVLIASNGSLLKVDVQGEIRLKSFLPSGSEMRIGLTEEFCVGKSELRGYGPGIRVDEVSFHSSVNLDEFESHRILRLQPPQGELTVMRYQLSDDLPSPLPFRLFPSVQWDRGSGRLQVYLKLRCDLLSKSQALNVRLHLPLPRGVVSLSQELSSPEQKAELAEGALRWDLPRVQGGSQLSGLFQMDVPGPPGPPSHGLSTSASPLGLGPASLSFELPRHTCSGLQVRFLRLAFRPCGNANPHKWVRHLSHSDAYVIRI

SEQ ID NO: 798757 - protein, 310 aa, Homo sapiens [sequence omitted]

SEQ ID NO: 798758 - protein, 325 aa, Homo sapiens; identical to SEQ ID NO: 798751

SEQ ID NO: 798759 - protein, 325 aa, Homo sapiens; identical to SEQ ID NO: 798751

SEQ ID NO: 798760 - protein, 104 aa, Homo sapiens
MLRNFIQTEAVVSKPFSLFDLSSVGLFGAETQQSKVAPSSAASRPVLSSRSDQSQKNEVFLDVVERLSVLIASNGIPVARWMCQGRDQVKEVYLLRGLEDAHMS

SEQ ID NO: 798761 - protein, 244 aa, Homo sapiens
MLLLGAVLLLLALPGHDQETTTQGPGVLLPLPKGACTGWMAGIPGHPGHNGAPGRDGRDGTPGEKGEKGDPGLIGPKGDIGETGVPGAEGPRGFPGIQGRKGEPGEGAYVYRSAFSVGLETYVTIPNMPIRFTKIFYNQQNHYDGSTGKFHCNIPGLYYFAYHITVYMKDVKVSLFKKDKAMLFTYDQYQENNVDQASGSVLLHLEVGDQVWLQVYGEGERNGLYADNDNDSTFTGFLLYHDTN

SEQ ID NO: 798762 - protein, 244 aa, Homo sapiens; identical to SEQ ID NO: 798761

SEQ ID NO: 798763 - protein, 123 aa, Homo sapiens
MDLETELSPSTGYFFLVSGFLGKQPITNFLGVKLQVEEQLDQTWKTCPQFVYSIELCMLGAPGLSTLNRTSQPAAPVQHHGSPLQSCNFESGYSDVTQVLQGMNTPTLKPLACRCGRKGSCML

SEQ ID NO: 798764 - protein, 351 aa, Homo sapiens
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPRTSNVRSTFFKDCLYEVFDDLESKMEDSGKQLLQSVLHLMENGALVLTTNFDNLLELYAADQGKQLESLDLTDEKKVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRENMLDKGIKVISYGDDYADLPEYFKRLTCEISTRGTSAGMVREGQLNGSSAAHSEIRGCST

SEQ ID NO: 798765 - protein, 351 aa, Homo sapiens; identical to SEQ ID NO: 798764

SEQ ID NO: 798766 - protein, 351 aa, Homo sapiens; identical to SEQ ID NO: 798764

SEQ ID NO: 798767 - protein, 250 aa, Homo sapiens
MRRAKSFRNVSMRTSNVRSTFFKDCLYEVFDDLESKMEDSGKQLLQSVLHLMENGALVLTTNFDNLLELYAADQGKQLESLDLTDEKKVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRENMLDKGIKVISYGDDYADLPEYFKRLTCEISTRGTSAGMVREGQLNGSSAAHSEIRGCST

SEQ ID NO: 798768 - protein, 348 aa, Homo sapiens
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPRTSNVRSTFFKDCLYEVFDDLESKMEDSGKQLLQSVLHLMENGALVLTTNFDNLLELYAADQGKQLESLDLTDEKKVLSPAKLVGLYVCVQVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRDLPEYFKRLTCEISTRGTSAGMVREGQLNGSSAAHSEIRGCST

SEQ ID NO: 798769 - protein, 220 aa, Homo sapiens
THNTPHKKQHRTTNGYGRGRVLIGRTLVLTTNFDNLLELYAADQGKQLESLDLTDEKKVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRENMLDKGIKVISYGDDYADLPEYFKRLTCEISTRGTSAGMVREGQLNGSSAAHSEIRGCST

SEQ ID NO: 798770 - protein, 82 aa, Homo sapiens
MTFLFQTCLECVFTMSICCIFSFQREIQKLYENKSFLFLGCGWTVDDTTFQALFLEAVKHKSDLEHFMLVRRGDVDEFKKLR

SEQ ID NO: 798771 - protein, 351 aa, Homo sapiens; identical to SEQ ID NO: 798764

SEQ ID NO: 798772 - protein, 366 aa, Homo sapiens
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPRTSNVRSTFFKDCLYEVFDDLESKMEDSGKQLLQSVLHLMENGALVLTTNFDNLLELYAADQGKQLESLDLTDEKKVLSPAKLVGLYVCVQVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRENMLDKGIKVISYGDDYADLPEYFKRLTCEISTRGTSAGMVREGQLNGSSAAHSEIRGCST

SEQ ID NO: 798773 - protein, 275 aa, Homo sapiens
MASTGSQASDIDEIFGFFNDGEPPTKKPRKLLPSLKTKKPRELVLVIGTGISAAVAPQVPALKSWKGLIQALLDAAIDFDLLEDEESKKFQKCLHEDKNLVHVAHDLIQKLSPVLEWAQEKRKLSVLHIHGVYTNPSGIVLHPAGYQNVLRNTEVMREIQKLYENKSFLFLGCGWTVDDTTFQALFLEAVKHKSDLEHFMLVRRGDVDEFKKLRENMLDKGIKVISYGDDYADLPEYFKRLTCEISTRGTSAGMVREGQLNGSSAAHSEIRGCST

SEQ ID NO: 798774 - protein, 106 aa, Homo sapiens
MKIEALPNQPPSQQMRHNYRLLASTVSAEMARNRQLIWELARQSEAHLDRPVVLGEQASAQREVASILCRKSVLAINQLAATVEGTISVLQQFNELLDHPLDPGRS

SEQ ID NO: 798775 - protein, 282 aa, Homo sapiens [sequence omitted]

SEQ ID NO: 798776 - protein, 282 aa, Homo sapiens [sequence omitted]

SEQ ID NO: 798777 - protein, 282 aa, Homo sapiens [sequence omitted]

SEQ ID NO: 798778 - protein, 229 aa, Homo sapiens
MEAAVKEEISVEDEAVDKNIFRDCNKIAFYRRQKQWLSKKSTYRALLDSVTTDEDSTRFQIINEASKVPLLAEIYGIEGNIFRLKINEETPLKPRFEVPDVLTSKPSTVRLISCSGDTGSLILADGKGDLKCHITANPFKVDLVSEEEVVISINSLGQLYFEHLQILHKQRAAKENEEETSVDTSQENQEDLGLWEEKFGKFVDIKANGPSSIGLDFSLHGFEHLYGIP

SEQ ID NO: 798779 - protein, 654 aa, Homo sapiens [sequence omitted]

SEQ ID NO: 798780 - protein, 171 aa, Homo sapiens
MGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKDIITLRNFWKQDVDGVASGPIVLHCAAEL

SEQ ID NO: 798781 - protein, 221 aa, Homo sapiens
PAGRGPRPCRPRTPPLPAEDPAPAGGCGSCCALRRLLSVGRGERGAAAAPAGAQAWRRRHWAAPQARRPRPWLSSARTPRRPFWRPPSCCSPMLTTSSGAGQRGRTAGTGVGGPRHLVRPGTGASGLSFRGQRRPDRPGPGAGSAPNVRARRPGASGPGQVPPPLEKRKFLCSCDLAPAVRVLRVNWSPGSGAGRRRGRKACFRHCRSSRRLTASDIGTQR

SEQ ID NO: 798782 - protein, 357 aa, Homo sapiens
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVVPQVGPTKSKKSFCPDIPNWSRGNLGAAPTIRYSRIGHGEGARNAPDEPLTPQNSQGEQPDAVYLKQILQLSGRPNNEATLTQRQHTAQPPSREPRYRPPPPTRSGELH

SEQ ID NO: 798783 - protein, 654 aa, Homo sapiens [sequence omitted]

SEQ ID NO: 798784 - protein, 221 aa, Homo sapiens
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGS

SEQ ID NO: 798785 - protein, 638 aa, Homo sapiens
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTDHVWTEVYSPSQQRWLHCDACEDVCDKPLLYEIGWGKKLSYVIAFSKDEVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGGKHLPGELITKYIFTTLKTNCTYLRCSSFSYLRVINTISVKK

SEQ ID NO: 798786 - protein, 221 aa, Homo sapiens; identical to SEQ ID NO: 798784

SEQ ID NO: 798787 - protein, 203 aa, Homo sapiens
PAGRGPRPCRPRTPPLPAEDPAPAGGCGSCCALRRLLSVGRGERGAAAAPAGAQAWRRRHWAAPQARRPRPWLSSARTPRRPFWRPPSCCSPMLTTSSGAGQRGRTAGTGVGGPRHLVRPGTGASGLSFRGQRRPDRPGPGAGSAPNVRARRPGASGPGQVPPPLEVNWSPGSGAGRRRGRKACFRHCRSSRRLTASDIGTQR

SEQ ID NO: 798788 - protein, 636 aa, Homo sapiens
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTELQRTLSLKLTTLKEIGKTFLRISKRQKLIQVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 798789 - protein, 636 aa, Homo sapiens
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTDHVWTEVYSPSQQRWLHCDACEDVCDKPLLYEIGWGKKLSYVIAFSKDEVVDVTWRYSCKHEEVIARRTKVKEALLRDTINGLNKQRQLFLSENRRKELLQRIIVELVEFISPKTPKPGELGGRISGSVAWRVARGEMGLQRKETLFIPYRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 798790 - protein, 558 aa, Homo sapiens
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTDHVWTEVYSPSQQRWLHCDACEDVCDKPLLYEIGWGKKLSYVIAFSKDEVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMITVFTPMLIFLVPLKLFWKQN

SEQ ID NO: 798791 - protein, 558 aa, Homo sapiens; identical to SEQ ID NO: 798790

SEQ ID NO: 798792 - protein, 165 aa, Homo sapiens
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQIIFCLYFLEV

SEQ ID NO: 798793 - protein, 709 aa, Homo sapiens
DEEGDDEETGSGEEEEEEAEAAAGWERSEDARLLRAGLPPAAVPAAAARDRSGRRPPRPPPGRPRMRPSGDEDRARRRRRRRRRRDLLLSQLCFLASVALLLWSLSSLREQKELDLMDLVGEDRKWMMARKLMQVNDTLTSEDAGLRNSKNCTEPALHEFPNDIFTNEDRRQGAVVLHVLCAIYMFYALAIVCDDFFVPSLEKICERLHLSEDVAGATFMAAGSSAPELFTSVIGVFITKGDVGVGTIVGSAVFNILCIIGVCGLFAGQVVALSSWCLLRDSIYYTLSVIALIVFIYDEKVSWWESLVLVLMYLIYIVIMKYNACIHQCFERRTKGAGNMVNGLANNAEIDDSSNCDATVVLLKKANFHRKASVIMVDELLSAYPHQLSFSEAGLRIMITSHFPPKTRLSMASRMLINERQRLINSRAYTNGESEVAIKIPIKHTVENGTGPSSAPDRGVNGTRRDDVVAEAGNETENENEDNENDEEEEEDEDDDEGPYTPFDTPSGKLETVKWAFTWPLSFVLYFTVPNCNKPRWEKWFMVTFASSTLWIAAFSYMMVWMVTIIGYTLGIPDVIMGITFLAAGTSVPDCMASLIVARQGMGDMAVSNSIGSNVFDILIGLGLPWALQTLAVDYGSYIRLNSRGLIYSVGLLLASVFVTVFGVHLNKWQLDKKLGCGCLLLYGVFLCFSIMTEFNVFTFVNLPMCGDH

SEQ ID NO: 798794 - protein, 709 aa, Homo sapiens; identical to SEQ ID NO: 798793

SEQ ID NO: 798795 - protein, 149 aa, Homo sapiens
DEEGDDEETGSGEEEEEEAEAAAGWERSEDARLLRAGLPPAAVPAAAARDRSGRRPPRPPPGRPRMRPSGDEDRARRRRRRRRRRDLLLSQLCFLASVALLLWSLSSLREQKAVPACALLTRELEVLLVAVVGSLTLHQPPRPGIKLWW

SEQ ID NO: 798796 - protein, 458 aa, Homo sapiens
FWGFALLGSLLFGVFAGQVVALSSWCLLRDSIYYTLSVIALIVFIYDEKVSWWESLVLVLMYLIYIVIMKYNACIHQCFERRTKGAGNMVNGLANNAEIDDSSNCDATVVLLKKANFHRKASVIMVDELLSAYPHQLSFSEAGLRIMITSHFPPKTRLSMASRMLINERQRLINSRAYTNGESEVAIKIPIKHTVENGTGPSSAPDRGVNGTRRDDVVAEAGNETENENEDNENDEEEEEDEDDDEGPYTPFDTPSGKLETVKWAFTWPLSFVLYFTVPNCNKPRWEKWFMVTFASSTLWIAAFSYMMVWMVTIIGYTLGIPDVIMGITFLAAGTSVPDCMASLIVARQGMGDMAVSNSIGSNVFDILIGLGLPWALQTLAVDYGSYIRLNSRGLIYSVGLLLASVFVTVFGVHLNKWQLDKKLGCGCLLLYGVFLCFSIMTEFNVFTFVNLPMCGDH

SEQ ID NO: 798797 - protein, 523 aa, Homo sapiens
MAGHTQQPSGRGNPRPAPSPSPVPGTVPGASERVALKKEIGLLSACTIIIGNIIGSGIFISPKGVLEHSGSVGLALFVWVLGGGVTALGSLCYAELGVAIPKSGGDYAYVTEIFGGLAGFLLLWSAVLIMYPTSLAVISMTFSNYVLQPVFPNCIPPTTASRVLSMACLMLLTWVNSSSVRWATRIQDMFTGGKLLALSLIIGVGLLQIFQGHFEELRPSNAFAFWMTPSVGHLALAFLQGSFAFSGWNFLNYVTEEMVDARKNLPRAIFISIPLVTFVYTFTNIAYFTAMSPQELLSSNAVAVTFGEKLLGYFSWVMPVSVALSTFGGINGYLFTYSRLCFSGAREGHLPSLLAMIHVRHCTPIPALLVCCGATAVIMLVGDTYTLINYVSFINYLCYGVTILGLLLLRWRRPALHRPIKVNLLIPVAYLVFWAFLLVFSFISEPMVCGVGVIIILTGVPIFFLGVFWRSKPKCVHRLTESMTHWGQELCFVVYPQDAPEEEENGPCPPSLLPATDKPSKPQ

SEQ ID NO: 798798 - protein, 450 aa, Homo sapiens
RVPVSRAAMLPPFLPQHPQQTQEMETMSCSRGWVSGVLHPQELTLTPPLPVTRNLPRAIFISIPLVTFVYTFTNIAYFTAMSPQELLSSNAVAVVSGPLLGPWLLPRPLPRPYTWPLYCAHPDLRGEAAGLLFLGHACLRGSVNLRRDQWLPVHLLQVTALGRRGHGEGRLGCRCAPVMPWARGRDTCRGRGLPEAGMMIPHGNKCLITTGRQRKQEAGRLDEGENCPVGLLGPEQEVRGDSLRGTSGPKLRPRMWPVPISVPNARLCFSGAREGHLPSLLAMIHVRHCTPIPALLVCCGATAVIMLVGDTYTLINYVSFINYLCYGVTILGLLLLRWRRPALHRPIKVNLLIPVAYLVFWAFLLVFSFISEPMVCGVGVIIILTGVPIFFLGVFWRSKPKCVHRLTESMTHWGQELCFVVYPQDAPEEEENGPCPPSLLPATDKPSKPQ

SEQ ID NO: 798799 - protein, 505 aa, Homo sapiens
PQSRARSQRMRPPVGAVPAARAVSSRTDGPTGGRPDRRGSAGSGDAAGQRHGRPHAAAERAREPQACALALPSPRDRPRRLGAGGAQEGDRAAERLHHHHRFLLLWSAVLIMYPTSLAVISMTFSNYVLQPVFPNCIPPTTASRVLSMACLMLLTWVNSSSVRWATRIQDMFTGGKLLALSLIIGVGLLQIFQGHFEELRPSNAFAFWMTPSVGHLALAFLQGSFAFSGWNFLNYVTEEMVDARKNLPRAIFISIPLVTFVYTFTNIAYFTAMSPQELLSSNAVAVTFGEKLLGYFSWVMPVSVALSTFGGINGYLFTYSRLCFSGAREGHLPSLLAMIHVRHCTPIPALLVCCGATAVIMLVGDTYTLINYVSFINYLCYGVTILGLLLLRWRRPALHRPIKVNLLIPVAYLVFWAFLLVFSFISEPMVCGVGVIIILTGVPIFFLGVFWRSKPKCVHRLTESMTHWGQELCFVVYPQDAPEEEENGPCPPSLLPATDKPSKPQ

SEQ ID NO: 798800 - protein, 142 aa, Homo sapiens
LTAAMRYEPANSHFFKTEIQYEKLADAVRFLGCFSDLRKISAMNVFPSNTQPFQRLLEEDVISIESVSPTLRHCSKLFIYLYKVATDSFDSRAEQIPPCLTSESSLPSPWGTPALSRKRHAYHSVSTPPVYPPKNVADLKLH

SEQ ID NO: 798801 - protein, 222 aa, Homo sapiens
FTAAHDVCQYQNTHCAIMPSDAISHTAARARTERELQQSLAGRLGLPLIDEVVSPEPEPLNTSDFSDWSSFNASSTPGPEEVDSASAAPAFYSQAPRPPASPGRPEQHTVIHMGNPEPLTHAPRKVYDTRDDDRTPGLHGDCDDDKYRRRPALGWLARLLRSRAGSRKRPLTLLQRAGLLLLLGLLGFLALLALMSRLGRAAADSDPNLDPLMNPHIRVGPS

SEQ ID NO: 798802 - protein, 71 aa, Homo sapiens
VFTSSGSGGVAQGRDGVISARRTRKRRGSGGIIGAAGAEGRGAGALGRVVPALPRLEPSLPPFGTSAAADQ

SEQ ID NO: 798803 - protein, 310 aa, Homo sapiens
MGLCKCPKRKVTNLFCFEHRVNVCEHCLVANHAKCIVQSYLQWLQDSDYNPNCRLCNIPLASRETTRLVCYDLFHWACLNERAAQLPRNTAPAGYQCPSCNGPIFPPTNLAGPVASALREKLATVNWARAGLGLPLIDEVVSPEPEPLNTSDFSDWSSFNASSTPGPEEVDSASAAPAFYSQAPRPPASPGRPEQHTVIHMGNPEPLTHAPRKVYDTRDDDRTPGLHGDCDDDKYRRRPALGWLARLLRSRAGSRKRPLTLLQRAGLLLLLGLLGFLALLALMSRLGRAAADSDPNLDPLMNPHIRVGPS

SEQ ID NO: 798804 - protein, 304 aa, Homo sapiens
MGLCKCPKRKVTNLFCFEHRVNVCEHCLCIVQSYLQWLQDSDYNPNCRLCNIPLASRETTRLVCYDLFHWACLNERAAQLPRNTAPAGYQCPSCNGPIFPPTNLAGPVASALREKLATVNWARAGLGLPLIDEVVSPEPEPLNTSDFSDWSSFNASSTPGPEEVDSASAAPAFYSQAPRPPASPGRPEQHTVIHMGNPEPLTHAPRKVYDTRDDDRTPGLHGDCDDDKYRRRPALGWLARLLRSRAGSRKRPLTLLQRAGLLLLLGLLGFLALLALMSRLGRAAADSDPNLDPLMNPHIRVGPS

SEQ ID NO: 798805 - protein, 110 aa, Homo sapiens [sequence omitted]

SEQ ID NO: 798806 - protein, 310 aa, Homo sapiens; identical to SEQ ID NO: 798803

SEQ ID NO: 798807 - protein, 71 aa, Homo sapiens; identical to SEQ ID NO: 798802

SEQ ID NO: 798808 - protein, 310 aa, Homo sapiens; identical to SEQ ID NO: 798803

SEQ ID NO: 798809 - protein, 226 aa, Homo sapiens
EYDECRPREDSLKGLKGEVAFSSYPNLPPVASALREKLATVNWARAGLGLPLIDEVVSPEPEPLNTSDFSDWSSFNASSTPGPEEVDSASAAPAFYSQAPRPPASPGRPEQHTVIHMGNPEPLTHAPRKVYDTRDDDRTPGLHGDCDDDKYRRRPALGWLARLLRSRAGSRKRPLTLLQRAGLLLLLGLLGFLALLALMSRLGRAAADSDPNLDPLMNPHIRVGPS

SEQ ID NO: 798810 - protein, 103 aa, Homo sapiens
LVRGWVYIGRGGEWSLPFRASSHRYRPSEPVQRPIRSIMGLCKCPKRKVTNLFCFEHRVNVCEHCLVANHAKVGPSGERLSRALGGQGGIGFLQIHEGPRARM

SEQ ID NO: 798811 - protein, 410 aa, Homo sapiens
MLMPLCGLLWWWWCCCSGWYCYGLCAPAPQMLRHQGLLKCRCRMLFNDLKVFLLRRPPQAPLPMHGDPQPPGLAANNTLPALGAGGWAGWRGPREVVGREPPPVPPPPPLPPSSVEDDWGGPATEPPASLLSSASSDDFCKEKTEDRYSLGSSLDSGMRTPLCRICFQGPEQGELLSPCRCDGSVKCTHQPCLIKWISERGCWSCELCYYKYHVIAISTKNPLQWQAISLTVIEKVQVAAAILGSLFLIASISWLIWSTFSPSARWQRQDLLFQICYGMYGFMDVVCIGLIIHEGPSVYRIFKRWQAVNQQWKVLNYDKTKDLEDQKAGGRTNPRTSSSTQANIPSSEEETAGTPAPEQGPAQAAGHPSGPLSHHHCAYTILHILSHLRPHEQRSPPGSSRELVMRVTTV

SEQ ID NO: 798812 - protein, 752 aa, Homo sapiens
GIWEEKLADEGVRAVDPRPPPGRPASEEGLWVGQGPPLGPPLVAGRPKIGPFPLPRPYRISGCARPGPARPTQPSARARRGGAAGAAPRDPERPPRHIQTSAAPAPSQPSWDSRAHPTQRRNPGPPGPSADSTAHFPGPPHTSQPSGRSLPTRCRVPPALSRPGSPPPGPRGGPSQAPFEPRRRPGLGRTMRLRLRLLALLLLLLAPPARAPKPSAQDVSLGVDWLTRYGYLPPPHPAQAQLQSPEKLRDAIKVMQRFAGLPETGRMDPGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKDGEGTDLFAVAVHEFGHALGLGHSSAPNSIMRPFYQGPVGDPDKYRLSQDDRDGLQQLYGKAPQTPYDKPTRKPLAPPPQPPASPTHSPSFPIPDRCEGNFDAIANIRGETFFFKGPWFWRLQPSGQLVSPRPARLHRFWEGLPAQVRVVQAAYARHRDGRILLFSGPQFWVFQDRQLEGGARPLTELGLPPGEEVDAVFSWPQNGKTYLVRGRQYWRYDEAAARPDPGYPRDLSLWEGAPPSPDDVTVSNAGDTYFFKGAHYWRFPKNSIKTEPDAPQPMGPNWLDCPAPSSGPRAPRPPKATPVSETCDCQCELNQAAGRWPAPIPLLLLPLLVGGVASR

SEQ ID NO: 798813 - protein, 752 aa, Homo sapiens; identical to SEQ ID NO: 798812

SEQ ID NO: 798814 - protein, 425 aa, Homo sapiens
GIWEEKLADEGVRAVDPRPPPGRPASEEGLWVGQGPPLGPPLVAGRPKIGPFPLPRPYRISGCARPGPARPTQPSARARRGGAAGAAPRDPERPPRHIQTSAAPAPSQPSWDSRAHPTQRRNPGPPGPSADSTAHFPGPPHTSQPSGRSLPTRCRVPPALSRPGSPPPGPRGGPSQAPFEPRRRPGLGRTMRLRLRLLALLLLLLAPPARAPKPSAQDVSLGVDWLTRYGYLPPPHPAQAQLQSPEKLRDAIKVMQRFAGLPETGRMDPGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKGLSAAGAGAGRRLTG

SEQ ID NO: 798815 - protein, 94 aa, Homo sapiens
SHPLSPADGEGTDLFAVAVHEFGHALGLGHSSAPNSIMRPFYQGPVGDPDKYRLSQDDRDGLQQLYGRGRGTCRETIIAPSSVLCSKARGRTPA

SEQ ID NO: 798816 - protein, 143 aa, Homo sapiens
MACQELGHTAGVELQKINAKLHDGVCQRCKEVLEWRVKYSKYKPLSKPKKCVKCLQKTVKDSYHIMCRPCACELEVCAKCGKKEDIVIPLNKETEKIEHTENNLSSNHRRSCRRNEESDDDLDFDIDLEDTGGLLEPWRRRLK

SEQ ID NO: 798817 - protein, 157 aa, Homo sapiens
MSSQKGNVARSRPQKHQNTFSFKNDKFDKSVQTKKINAKLHDGVCQRCKEVLEWRVKYSKYKPLSKPKKCVKCLQKTVKDSYHIMCRPCACELEVCAKCGKKEDIVIPLNKETEKIEHTENNLSSNHRRSCRRNEESDDDLDFDIDLEDTGGDHQMN

SEQ ID NO: 798818 - protein, 73 aa, Homo sapiens
VEAAPRGVAWLNSREGRAMLFDLPEESRGLTQSRGGKAALVSSGSLTEASIPGSSSLVFFPLILLPAPGEGWL

SEQ ID NO: 798819 - protein, 73 aa, Homo sapiens; identical to SEQ ID NO: 798818

SEQ ID NO: 798820 - protein, 73 aa, Homo sapiens; identical to SEQ ID NO: 798818

SEQ ID NO: 798821 - protein, 73 aa, Homo sapiens; identical to SEQ ID NO: 798818

SEQ ID NO: 798822 - protein, 73 aa, Homo sapiens; identical to SEQ ID NO: 798818

SEQ ID NO: 798823 - protein, 73 aa, Homo sapiens; identical to SEQ ID NO: 798818

SEQ ID NO: 798824 - protein, 108 aa, Homo sapiens
MSSQKGNVARSRPQKHQNTFSFKNDKFDKSVQTKKINAKLHDGVCQRCKEVLEWRVKYSKYKPLSKPKKCWSLGNKSETPSQINKSNNKLKELKSSGQLIEALEVGVK

SEQ ID NO: 798825 - protein, 112 aa, Homo sapiens
KGTSGSLADVFANTRIENFSAPPDVTTTTSSSSSSSSIRPANIDLPPSGIVKGMHKGSNRSSLMDTADGVPVSSRVSTKIQQLLNTLKRPKRPPLKEFFVDDSEEIVEGSSK

SEQ ID NO: 798826 - protein, 1596 aa, Homo sapiens [sequence omitted]

SEQ ID NO: 798827 - protein, 1592 aa, Homo sapiens
VTCRLSGARELHCNLVGFFWGGNVSESNVSLIERRTGKKWSSRRSCRSDLFLNTSSCLHPWESDPSNWTTLFLEFWVAGDGLEEQEFSIKEANFTEGSLKLKIQTTKRAKKPPKNLENYICPPEIKITIKQSGDQKVSRAGKNSKATKEEERSHSKKKLLTASDLAASDLKGFQPQAYERPQKHSTLHYDTGLPQDFTGDTLKPKHQQKSSSQNHMDWSTNSDSGPVTQNCFISPESGRETASTSKIPALEPVASFAKAQGKKGSAGNTWSQLSNNNKDLLLGGVAPSPSSHSSPAPPSSSAECNGLQPLVDQDGGGTKEPPEPPTVGSKKKSSKKDVISQTIPNPDLDWVKNAQKAFDNTEGKREGYSADSAQEASPARQNVSSASNPENDSSHVRITIPIKAPSLDPTNHKRKKRQSIKAVVEKIMPEKALASGITMSSEVVNRILSNSEGNKKDPRVPKLSKMIENESPSVGLETGGNAEKVIPGGVSKPRKPPMVMTPPTCTDHSPSRKLPEIQHPKFAAKRRWTCSKPKPSTMLREAVMATSDKLMLEPPSAYPITPSSPLYTNTDSLTVITPVKKKRGRPKKQPLLTVETIHEGTSTSPVSPISREFPGTKKRKRRRNLAKLAQLVPGEDKPMSEMKFHKKVGKLGVLDKKTIKTINKMKTLKRKNILNQILSCSSSVALKAKAPPETSPGAAAIESKLGKQINVSKRGTIYIGKKRGRKPRAELPPPSEEPKTAIKHPRPVSSQPDVPAVPSNFQSLVASSPAAMHPLSTQLGGSNGNLSPASTETNFSELKTMPNLQPISALPTKTQKGIHSGTWKLSPPRLMANSPSHLCEIGSLKEITLSPVSESHSEETIPSDSGIGTDNNSTSDQAEKSSESRRRYSFDFCSLDNPEAIPSDTSTKNRHGHRQKHLIVDNFLAHESLKKPKHKRKRKSLQNRDDLQFLADLEELITKFQVFRISHRSYTFYHENPYPSIFRINFDHYYPVPYIQYDPLLYLRRTSDLKSKKKRGRPAKTNDTMTKVPFLQGFSYPIPSGSYYAPYGMPYTSMPMMNLGYYGQYPAPLYLSHTLGAASPFMRPTVPPPQFHTNSHIKMSGAAKHKAKHGVHLQGPVSMGLGDMQPSLNPPKVGSASLSSGRLHKRKHKHKHKHKEDRILGTHDNLSGLFAGKATGFSSHILSERLSSADKELPLVSEKNKHKEKQKHQHSEAGHKASKNNFEVDTLSTLSLSDAQHWTQAKEKGDLSSEPVDSCTKRYSGSGGDGGSTRSENLDVFSEMNPSNDKWDSDVSGSKRRSYEGFGTYREKDIQAFKMNRKERSSYDSSMSPGMPSPHLKVDQTAVHSKNEGSVPTMMTRKKPAAVDSVTIPPAPVLSLLAASAATSDAVGSSLKKRFKRREIEAIQCEVRKMCNYTKILSTKKNLDHVNKILKAKRLQRQSKTGNNFVKKRRGRPRKQPTQFDEDSRDQMPVLEKCIDLPSKRGQKPSLSPLVLEPAASQDTIMATIEAVIHMAREAPPLPPPPPPPLPPPPPPPLPPPPPLPKTPRGGKRKHKPQAPAQPPQQSPPQQPLPQEEEVKAKRQRKSRGSESEVLP

SEQ ID NO: 798828 - protein, 1206 aa, Homo sapiens
GFLLCHPGLLPASIPIKAPSLDPTNHKRKKRQSIKAVVEKIMPEKALASGITMSSEVVNRILSNSEGNKKDPRVPKLSKMIENESPSVGLETGGNAEKVIPGGVSKPRKPPMVMTPPTCTDHSPSRKLPEIQHPKFAAKRRWTCSKPKPSTMLREAVMATSDKLMLEPPSAYPITPSSPLYTNTDSLTVITPVKKKRGRPKKQPLLTVETIHEGTSTSPVSPISREFPGTKKRKRRRNLAKLAQLVPGEDKPMSEMKFHKKVGKLGVLDKKTIKTINKMKTLKRKNILNQILSCSSSVALKAKAPPETSPGAAAIESKLGKQINVSKRGTIYIGKKRGRKPRAELPPPSEEPKTAIKHPRPVSSQPDVPAVPSNFQSLVASSPAAMHPLSTQLGGSNGNLSPASTETNFSELKTMPNLQPISALPTKTQKGIHSGTWKLSPPRLMANSPSHLCEIGSLKEITLSPVSESHSEETIPSDSGIGTDNNSTSDQAEKSSESRRRYSFDFCSLDNPEAIPSDTSTKNRHGHRQKHLIVDNFLAHESLKKPKHKRKRKSLQNRDDLQFLADLEELITKFQVFRISHRSYTFYHENPYPSIFRINFDHYYPVPYIQYDPLLYLRRTSDLKSKKKRGRPAKTNDTMTKVPFLQGFSYPIPSGSYYAPYGMPYTSMPMMNLGYYGQYPAPLYLSHTLGAASPFMRPTVPPPQFHTNSHIKMSGAAKHKAKHGVHLQGPVSMGLGDMQPSLNPPKVGSASLSSGRLHKRKHKHKHKHKEDRILGTHDNLSGLFAGKATGFSSHILSERLSSADKELPLVSEKNKHKEKQKHQHSEAGHKASKNNFEVDTLSTLSLSDAQHWTQAKEKGDLSSEPVDSCTKRYSGSGGDGGSTRSENLDVFSEMNPSNDKWDSDVSGSKRRSYEGFGTYREKDIQAFKMNRKERSSYDSSMSPGMPSPHLKVDQTAVHSKNEGSVPTMMTRKKPAAVDSVTIPPAPVLSLLAASAATSDAVGSSLKKRFKRREIEAIQCEVRKMCNYTKILSTKKNLDHVNKILKAKRLQRQSKTGNNFVKKRRGRPRKQPTQFDEDSRDQMPVLEKCIDLPSKRGQKPSLSPLVLEPAASQDTIMATIEAVIHMAREAPPLPPPPPPPLPPPPPPPLPPPPPLPKTPRGGKRKHKPQAPAQPPQQSPPQQPLPQEEEVKAKRQRKSRGSESEVLP

SEQ ID NO: 798829 - protein, 1596 aa, Homo sapiens [sequence omitted]

SEQ ID NO: 798830 - protein, 1380 aa, Homo sapiens
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSGDQKVSRAGKNSKATKEEERSHSKKKLLTASDLAASDLKGFQPQAYERPQKHSTLHYDTGLPQDFTGDTLKPKHQQKSSSQNHMDWSTNSDSGPVTQNCFISPESGRETASTSKIPALEPVASFAKAQGKKGSAGNTWSQLSNNNKDLLLGGVAPSPSSHSSPAPPSSSAECNGLQPLVDQDGGGTKEPPEPPTVGSKKKSSKKDVISQTIPNPDLDWVKNAQKAFDNTEGKREGYSADSAQEASPARQNVSSASNPENDSSHVRITIPIKAPSLDPTNHKRKKRQSIKAVVEKIMPEKALASGITMSSEVVNRILSNSEGNKKDPRVPKLSKMIENESPSVGLETGGNAEKVIPGGVSKPRKPPMVMTPPTCTDHSPSRKLPEIQHPKFAAKRRWTCSKPKPSTMLREAVMATSDKLMLEPPSAYPITPSSPLYTNTDSLTVITPVKKKRGRPKKQPLLTVETIHEGTSTSPVSPISREFPGTKKRKRRRNLAKLAQLVPGEDKPMSEMKFHKKVGKLGVLDKKTIKTINKMKTLKRKNILNQILSCSSSVALKAKAPPETSPGAAAIESKLGKQINVSKRGTIYIGKKRGRKPRAELPPPSEEPKTAIKHPRPVSSQPDVPAVPSNFQSLVASSPAAMHPLSTQLGGSNGNLSPASTETNFSELKTMPNLQPISALPTKTQKGIHSGTWKLSPPRLMANSPSHLCEIGSLKEITLSPVSESHSEETIPSDSGIGTDNNSTSDQAEKSSESRRRYSFDFCSLDNPEAIPSDTSTKNRHGHRQKHLIVDNFLAHESLKKPKHKRKRKSLQNRDDLQFLADLEELITKFQVFRISHRSYTFYHENPYPSIFRINFDHYYPVPYIQYDPLLYLRRTSDLKSKKKRGRPAKTNDTMTKVPFLQGFSYPIPSGSYYAPYGMPYTSMPMMNLGYYGQYPAPLYLSHTLGAASPFMRPTVPPPQFHTNSHIKMSGAAKHKAKHGVHLQGPVSMGLGDMQPSLNPPKVGSASLSSGRLHKRKHKHKHKHKEDRILGTHDNLSGLFAGKATGFSSHILSERLSSADKELPLVSEKNKHKEKQKHQHSEAGHKASKNNFEVDTLSTLSLSDAQHWTQAKEKGDLSSEPVDSCTKRYSGSGGDGGSTRSENLDVFSEMNPSNDKWDSDVSGSKRRSYEGFGTYREKDIQAFKMNRKERSSYDSSMSPGKAVFLQKWIIKLFHCWALHLRHICGTLCSLVCKEVGIKLKWVSLHI

SEQ ID NO: 798831 - protein, 1080 aa, Homo sapiens
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSGDQKVSRAGKNSKATKEEERSHSKKKLLTASDLAASDLKGFQPQAYERPQKHSTLHYDTGLPQDFTGDTLKPKHQQKSSSQNHMDWSTNSDSGPVTQNCFISPESGRETASTSKIPALEPVASFAKAQGKKGSAGNTWSQLSNNNKDLLLGGVAPSPSSHSSPAPPSSSAECNGLQPLVDQDGGGTKEPPEPPTVGSKKKSSKKDVISQTIPNPDLDWVKNAQKAFDNTEGKREGYSADSAQEASPARQNVSSASNPENDSSHVRITIPIKAPSLDPTNHKRKKRQSIKAVVEKIMPEKALASGITMSSEVVNRILSNSEGNKKDPRVPKLSKMIENESPSVGLETGGNAEKVIPGGVSKPRKPPMVMTPPTCTDHSPSRKLPEIQHPKFAAKRRWTCSKPKPSTMLREAVMATSDKLMLEPPSAYPITPSSPLYTNTDSLTVITPVKKKRGRPKKQPLLTVETIHEGTSTSPVSPISREFPGTKKRKRRRNLAKLAQLVPGEDKPMSEMKFHKKVGKLGVLDKKTIKTINKMKTLKRKNILNQILSCSSSVALKAKAPPETSPGAAAIESKLGKQINVSKRGTIYIGKKRGRKPRAELPPPSEEPKTAIKHPRPVSSQPDVPAVPSNFQSLVASSPAAMHPLSTQLGGSNGNLSPASTETNFSELKTMPNLQPISALPTKTQKGIHSGTWKLSPPRLMANSPSHLCEIGSLKEITLSPVSESHSEETIPSDSGIGTDNNSTSDQAEKSSESRRRYSFDFCSLDNPEAIPSDTSTKNRHGHRQKHLIVDNFLAHESLKKPKHKRKRKSLQNRDDLQFLADLEELITKFQVFRISHRSYTFYHENPYPSIFRINFDHYYPVPYIQYDPLLYLRRTSDLKSKKKRGRPAKTNDTMTKVPFLQGFSYPIPSGSYYAPYGMPYTSMPMMNLGYYGQYPAPLYLSRLVA

SEQ ID NO: 798832 - protein, 485 aa, Homo sapiens [sequence omitted]

SEQ ID NO: 798833 - protein, 485 aa, Homo sapiens [sequence omitted]

SEQ ID NO: 798834 - protein, 432 aa, Homo sapiens
MAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 798835 - protein, 379 aa, Homo sapiens
MLSLSLSLSLSLSLSLSLSLSLSLSLSLSRSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 798836 - protein, 277 aa, Homo sapiens [sequence omitted]

SEQ ID NO: 798837 - protein, 97 aa, Homo sapiens
DAVGRPTRRGRVGEEVANKVKVPLQDLMVRNDTPCGTTIGPILASRLGLRVLDLGSPQLAMHSIREMACTTGVLQTLTLFKGFFELFPSLSHNLLVD

SEQ ID NO: 798838 - protein, 296 aa, Homo sapiens
GLKLSTEFQPWVWVSRWGRAEAEVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQA

SEQ ID NO: 798839 - protein, 432 aa, Homo sapiens; identical to SEQ ID NO: 798834

SEQ ID NO: 798840 - protein, 471 aa, Homo sapiens
MNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 798841 - protein, 525 aa, Homo sapiens
ASWGPRQGKDPAKKAHGSGLSTPALGGGEQVTMARSLSIMFVPNSWLNGYHKVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 798842 - protein, 432 aa, Homo sapiens; identical to SEQ ID NO: 798834

SEQ ID NO: 798843 - protein, 421 aa, Homo sapiens
CAHLGLCPKIVEMELCLADTQPAVLGGAYDEFIFAQLFPTRTAPVCVVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 798844 - protein, 449 aa, Homo sapiens
MSGHSPTRGAMQVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 798845 - protein, 328 aa, Homo sapiens
MSGHSPTRGAMQVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEGFFELFPSLSHNLLVD

SEQ ID NO: 798846 - protein, 328 aa, Homo sapiens; identical to SEQ ID NO: 798845

SEQ ID NO: 798847 - protein, 134 aa, Homo sapiens [sequence omitted]

SEQ ID NO: 798848 - protein, 115 aa, Homo sapiens
MSEVGEGWTGSSSRRSLLPPLVLHLGNGLNGLPSFHPQNGCPALPSEILFCTGPPSELLWADKAVSHPPKIPSHPLSGAAKRRAQSISYHPSSSTSQQSLVLLDCEHIIRKKDYH

SEQ ID NO: 798849 - protein, 458 aa, Homo sapiens
MSGHSPTRGAMQVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLGSPQLAMHSIREMACTTGVLQTLTLFKGFFELFPSLSHNLLVD

SEQ ID NO: 798850 - protein, 460 aa, Homo sapiens
ISLPGGLSVVTGPSFVHYAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 798851 - protein, 499 aa, Homo sapiens
MSGHSPTRGAMQVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPDQGGKGPNVVGPTGYYNPSVTPEKLFTKEPLNPQIYHQPLNQLADLAFNIVLLLKPPSIAEPRVNYTKVYLLRPLRAGTHPCQGGTAAVAGDAPHSSPILSATRAAQKHKQQGARRRM

SEQ ID NO: 798852 - protein, 323 aa, Homo sapiens
MSGHSPTRGAMQVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIRFLCKAWVLARTSSGLFPLYETKVGLNAQASLLKTV

SEQ ID NO: 798853 - protein, 122 aa, Homo sapiens
FPLGLSLPLPHLDSPQGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 798854 - protein, 110 aa, Homo sapiens
MWGQVSYKPLGSKSILRWHTISHNCIKKGFSLTSIKTKYLGEEETQVRGSRSHSTKDAISDTHPSLESYGTYFNIPTNTGQQRRQWLIFIIPQALTTGPTGSCKKKKMNE

SEQ ID NO: 798855 - protein, 529 aa, Homo sapiens
FHEASPWQVKKEDTIVPPNLRSRSWETLPSVEKKTPGPPFGTQIWKGLCIESKQLVSAPGAILKSPSVLQMRQFIQHEVIKNEVKLRLQVSLKDYINYILKKEDELQEMMVKDSRTEEERGNAADLLKLVMSFPKMEETTKSHVTEVAAHLTDLFKQSLATPPKCPPDTFGKDFFEKTWRHTASSKRWKEKIDKTRKEIETTQNYLMDIKNRIIPPFFKSELNQLYQSQYNHLDSLSKKLPSFTKKNEDANETAVQDTSDLNLDFKPHKVSEQKSSSVPSLPKPEISADKKDFTAQNQTENLTKSPEEAESYEPVKIPTQSLLQDVAGQTRKEKVKLPHYLLSSKPKSQPLAKVQDSVGGKVNTSSVASAAINNAKSSLFGFHLLPSSVKFGVLKEGHTYATVVKLKNVGVDFCRFKVKQPPPSTGLKVTYKPGPVAAGMQTELNIELFATAVGEDGAKGSAHISHNIEIMTEHEVLFLPVEATVLTSSNYDKRPKDFPQGKENPMVQRTSTIYSSTLGVFMSRKVSPH

SEQ ID NO: 798856 - protein, 529 aa, Homo sapiens; identical to SEQ ID NO: 798855

SEQ ID NO: 798857 - protein, 529 aa, Homo sapiens; identical to SEQ ID NO: 798855

SEQ ID NO: 798858 - protein, 415 aa, Homo sapiens
FHEASPWQVKKEDTIVPPNLRSRSWETLPSVEKKTPGPPFGTQIWKGLCIESKQLVSAPGAILKSPSVLQMRQFIQHEVIKNEVKLRLQVSLKDYINYILKKEDELQEMMVKDSRTEEERGNAADLLKLVMSFPKMEETTKSHVTEVAAHLTDLFKQSLATPPKCPPDTFGKDFFEKTWRHTASSKRWKEKIDKTRKEIETTQNYLMDIKNRIIPPFFKSELNQLYQSQYNHLDSLSKKLPSFTKKNEDANETAVQDTSDLNLDFKPHKVSEQKSSSVPSLPKPEISADKKDFTAQNQTENLTKSPEEAESYEPVKIPTQSLLQDVAGQTRKEKVKLPHYLLSSKPKSQPLAKVQDSVGGKVNTSSVASAAINNAKSSLFGFHLLPSSVKFGVLKEGHTYATVVKLKNVGVDFCR

SEQ ID NO: 798859 - protein, 35 aa, Homo sapiens
MVATGGLGDGARLDAGSRSPVVRRLLMHSVQRGGG

SEQ ID NO: 798860 - protein, 35 aa, Homo sapiens; identical to SEQ ID NO: 798859

SEQ ID NO: 798861 - protein, 134 aa, Homo sapiens
HNIVKYPQCRQHALMTIQQLVLSPNGDDDMGTLLGLMHSAPPTELQLKTDILRALLSVLRESHRSRTVFRKVGGFVYITSLLVAMERSLSCPPKNGWEKVNQNQVFELLHTVFCTLTAAMRYEPANSHFFKTEI

SEQ ID NO: 798862 - protein, 354 aa, Homo sapiens
MGPVSLLPKYQKLNTWNGDLAKMTHLQAGLSPETIEKARLELNENPDVLHQDIQQVRDMIITRPDIGFLRTDDAFILRFLRARKFHQADAFRLLAQYFQYRQLNLDMFKNFKADDPGIKRALIDGFPGVLENRDHYGRKILLLFAANWDQSRNSFTDILRAILLSLEVLIEDPELQINGFILIIDWSNFSFKQASKLTPSILKLAIEGLQDSFPARFGGVHFVNQPWYIHALYTLIKPFLKDKTRKRIFLHGNNLNSLHQLIHPEFLPSEFGGTLPPYDMGTWARTLLGPDYSDENDYTHTSYNAMHVKHTSSNLERECSPKLMKRSQSVVEAGTLKHEEKGENENTQPLLALD

SEQ ID NO: 798863 - protein, 354 aa, Homo sapiens; identical to SEQ ID NO: 798862

SEQ ID NO: 798864 - protein, 232 aa, Homo sapiens
MGPVSLLPKYQKLNTWNGDLAKMTHLQAGLSPETIEKARLELNENPDVLHQDIQQVRDMIITRPDIGFLRTDDAFILRFLRARKFHQADAFRLLAQYFQYRQLNLDMFKNFKADDPGIKRALIDGFPGVLENRDHYGRKILLLFAANWDQSRNSFTDILRAILLSLEVLIEDPELQINGFILIIDWSNFSFKQASKLTPSILKLAIEGLQKMDKINAEDLFRRTVMPELVIH

SEQ ID NO: 798865 - protein, 326 aa, Homo sapiens
MGPVSLLPKYQKLNTWNGDLAKMTHLQAGLSPETIEKARLELNENPDVLHQDIQQVRDMIITRPDIGFLRTDDAFILRFLRARKFHQADAFRLLAQYFQYRQLNLDMFKNFKADDPGIKRALIDGFPGVLENRDHYGRKILLLFAANWDQSRNSFTDILRAILLSLEVLIEDPELQINGFILIIDWSNFSFKQASKLTPSILKLAIEGLQDSFPARFGGVHFVNQPWYIHALYTLIKPFLKDKTRKRIFLHGNNLNSLHQLIHPEFLPSEFGGTLPPYDMGTWARTLLGPDYSDENDYTHTSYNAMHVKHTSSNLERECSPKLMKR

SEQ ID NO: 798866 - protein, 92 aa, Homo sapiens
TPPTKITAPCGARALIHSFLEKSEPEPARIGDLTHPVQQRGHLQKYIPKARLGGRVKELLHRHPSCHPAVIGSPNRRSGASDKWLHFNYRLE

SEQ ID NO: 798867 - protein, 367 aa, Homo sapiens
MGPVSLLPKYQKLNTWNGDLAKMTHLQAGLSPETIEKARLELNENPDVLHQDIQQVRDMIITRPDIGFLRTDDAFILRFLRARKFHQADAFRLLAQYFQYRQLNLDMFKNFKADDPGIKRALIDGFPGVLENRDHYGRKILLLFAANWDQSRNSFTDILRAILLSLEVLIEDPELQINGFILIIDWSNFSFKQASKLTPSILKLAIEGLQDSFPARFGGVHFVNQPWYIHALYTLIKPFLKDKTRKRIFLHGNNLNSLHQLIHPEFLPSEFGGTLPPYDMGTWARTLLGPDYSDENDYTHTSYNAMHVKHTSSNLERECSPKLMKSSEGWKGKIKVLARSQSVVEAGTLKHEEKGENENTQPLLALD

SEQ ID NO: 798868 - protein, 191 aa, Homo sapiens
MGPVSLLPKYQKLNTWNGDLAKMTHLQAGLSPETIEKARLELNENPDVLHQDIQQVRDMIITRPDIGFLRTDDAFILRFLRARKFHQADAFRLLAQYFQYRQLNLDMFKNFKADDPGIKRALIDGFPGVLENRDHYGRKILLLFAANWDQSRNSFTDILRAILLSLEVLIEDPELQINGFILIFPSNKPPN

SEQ ID NO: 798869 - protein, 224 aa, Homo sapiens
MSSYFVNSTFPVTLASGQESFLGQLPLYSSGYADPLRHYPAPYGPGPGQDKGFATSSYYPPAGGGYGRAAPCDYGPAPAFYREKESACALSGADEQPPFHPEPRKSDCAQDKSVFGETEEQKCSTPVYPWMQRMNSCNSSSFGPSGRRGRQTYTRYQTLELEKEFHYNRYLTRRRRIEIAHALCLTERQIKIWFQNRRMKWKKESKLLSASQLSAEEEEEKQAE

SEQ ID NO: 798870 - protein, 140 aa, Homo sapiens
MSSYFVNSTFPVTLASGQESFLGQLPLYSSGYADPLRHYPAPYGPGPGQDKGFATSSYYPPAGGGYGRAAPCDYGPAPAFYREKESACALSGADEQPPFHPEPRKSDCAQDKSVFGETEEQKCSTPVYPWMQRMNSCNSE

SEQ ID NO: 798871 - protein, 110 aa, Homo sapiens
MCCVCSLVLALDVKYFDDDDDDDDDNNNNNNNNNNNNKDVKTRRSVTSNPPLPFFPLSSTPSLSIFPEPEFFSKGESPGPPKRALFDWEVTAEIKAGAISPAQAPALRFP

SEQ ID NO: 798872 - protein, 110 aa, Homo sapiens; identical to SEQ ID NO: 798871

SEQ ID NO: 798873 - protein, 140 aa, Homo sapiens; identical to SEQ ID NO: 798870

SEQ ID NO: 798874 - protein, 118 aa, Homo sapiens
NYQEGSKPTTGRRMISSLCPDLLGQFLLLENPIAQAILKSFGIVEGTGVRVAGRIGIRQIKPPRLRDTPHSFTPYHQVRRGLVSFPSAPSPAKGEQLHTRTRQNVLGSHPRRRLSRSS

SEQ ID NO: 798875 - protein, 212 aa, Homo sapiens
LGFSGTQRSQWFWPPRACPSPSCHPSLVSASGYCPSAVLLPGADIAGFPAALACEAVALRDVLVSIGPGISAEAGEGEETARETQKRQFTEKCLLSPFGDIFEIKGLWVETPKMRETPPSPGSLPENAQVSRHSRRREPRSTGRQFCGFNAVGYSCWFLRDTDSITCVVLVWDVWISVEEKIAMCVSDMITFQTFLGPDMVIVKKLLSAFLF

SEQ ID NO: 798876 - protein, 140 aa, Homo sapiens; identical to SEQ ID NO: 798870

SEQ ID NO: 798877 - protein, 224 aa, Homo sapiens; identical to SEQ ID NO: 798869

SEQ ID NO: 798878 - protein, 224 aa, Homo sapiens; identical to SEQ ID NO: 798869

SEQ ID NO: 798879 - protein, 110 aa, Homo sapiens; identical to SEQ ID NO: 798871

SEQ ID NO: 798880 - protein, 153 aa, Homo sapiens
SQSALGRRNLPQAPGPGVQGPLSCQGPGRCGPQRRGRGLSRGRSCKQPQRPGLASKSRASQAQPRAAQAPSLPRGRRARGPGHRRGVGSPPRRAPGARGAAPGAEKGEVRTYLSLLSTPSWIHLSTSPQSIMGPTATRMALRLHKTNFLFLHQ

SEQ ID NO: 798881 - protein, 127 aa, Homo sapiens
EFTKPLEDQTVEEGATAVLECEVSRENAKVKWFKNGTEILKSKKYEIVADGRVRKLVIHDCTPEDIKTYTCDAKDFKTSCNLNVVPPHVEFLRPLTDLQVREKEMARFECELSRENAKVCDCIPVIL

SEQ ID NO: 798882 - protein, 288 aa, Homo sapiens
MNNLSFSELCCLFCCPPCPGKIASKLAFLPPDPTYTLMCDESGSRWTLHLSERADWQYSSREKDAIECFMTRTSKGNRIACMFVRCSPNAKYTLLFSHGNAVDLGQMSSFYIGLGSRINCNIFSYDYSGYGASSGKPTEKNLYADIEAAWLALRTRYGIRPENVIIYGQSIGTVPSVDLAARYESAAVILHSPLTSGMRVAFPDTKKTYCFDAFPNIDKISKITSPVLIIHGTEDEVIDFSHGLALFERCQRPVEPLWVEGAGHNDVELYGQYLERLKQFVSQELVNL

SEQ ID NO: 798883 - protein, 288 aa, Homo sapiens; identical to SEQ ID NO: 798882

SEQ ID NO: 798884 - protein, 288 aa, Homo sapiens; identical to SEQ ID NO: 798882

SEQ ID NO: 798885 - protein, 293 aa, Homo sapiens
MNNLSFSELCCLFCCPPCPGKIASKLAFLPPDPTYTLMCDESGSRWTLHLSERADWQYSSREKDAIECFMTRTSKGNRIACMFVRCSPNAKYTLLFSHGNAVDLGQMSSFYIGLGSRINCNIFSYDYSGYGASSGKPTEKNLYADIEAAWLALRTRYGIRPENVIIYGQSIGTVPSVDLAARYESAAVILHSPLTSGMRVAFPDTKKTYCFDAFPNIDKISKITSPVLIIHGTEDEVIDFSHGLALFERCQRPVEPLWVEGAGHNDVELYGQYLERLKQFVSQELVQKHKEGK

SEQ ID NO: 798886 - protein, 288 aa, Homo sapiens; identical to SEQ ID NO: 798882

SEQ ID NO: 798887 - protein, 74 aa, Homo sapiens
ATGLRRPEPGSTEETRRLLGQGGERSVGREESVEPPFHSLRERIGRAHEPSNPWLKHPLPKPGYFLSVATPMKL

SEQ ID NO: 798888 - protein, 77 aa, Homo sapiens
GLLGCGDQSPAPLKKPAGCWGRAAKGQSAERSPWSHRFIASGKGSGVLTSPLTHGLNTRFLSLVPEYITCGDKHEDV

SEQ ID NO: 798889 - protein, 101 aa, Homo sapiens
ATGLRRPEPGSTEETRRLLGQGGERSVGREESVEPPFHSLRERIGRAHEPSNPWLKHPLPKPGFLCLCLKNMVPCEILHVEESFTLRELSGYNYFRQILGT

SEQ ID NO: 798890 - protein, 77 aa, Homo sapiens; identical to SEQ ID NO: 798888

SEQ ID NO: 798891 - protein, 77 aa, Homo sapiens; identical to SEQ ID NO: 798888

SEQ ID NO: 798892 - protein, 77 aa, Homo sapiens; identical to SEQ ID NO: 798888

SEQ ID NO: 798893 - protein, 77 aa, Homo sapiens; identical to SEQ ID NO: 798888

SEQ ID NO: 798894 - protein, 286 aa, Homo sapiens
CRSPTAEPGLLSSRRARTIQHRLRRVPPSSGSDWLTHGKREKPGPLETRLLEERKYCVDVRLSKGGSEFSSEVAPVRQQGSVAGARAGVVSLLGCRSSWTAAMELSAEYLREKLQRDLEAEHVLDPSMTIHCDMVITYGLDQLENCQTCGTNYIISVLNLLTLIVEQINTKLPSSFVEKLFIPSSKLLFLRYHKEKEVVAVAHAVYQAMLSLKNIPVLETAYKLILGEMTCALNNLLHSLQLPEACSEIKHEAFKNHVFNVDNAKFVVKFDLSALTTIGNAKNSSL

SEQ ID NO: 798895 - protein, 185 aa, Homo sapiens
VGSGRFGRRLALLWAAALGHVVSGKVMSRRAPGSRLSSGGTNYSRSWNDWQPRTDSASADPGNLKYSSSRDRGGSSSYGLQPSNSAVVSRQRHDDTRVHADIQNDEKGGYSVNGGSGENTYGRKSLGQELRVNNVTSPEFTSVQHGSRALATKDMRKSQERSMSYCDESRLSNLLRRITREDDRD

SEQ ID NO: 798896 - protein, 193 aa, Homo sapiens
MRCVTAANQVFFSEAVLTAANECVGVLLGSLDPSMTIHCDMVITYGLDQLENCQTCGTNYIISVLNLLTLIVEQINTKLPSSFVEKLFIPSSKLLFLRYHKEKEVVAVAHAVYQAMLSLKNIPVLETAYKLILGEMTCALNNLLHSLQLPEACSEIKHEAFKNHVFNVDNAKFVVKFDLSALTTIGNAKNSSL

SEQ ID NO: 798897 - protein, 193 aa, Homo sapiens; identical to SEQ ID NO: 798896

SEQ ID NO: 798898 - protein, 193 aa, Homo sapiens; identical to SEQ ID NO: 798896

SEQ ID NO: 798899 - protein, 193 aa, Homo sapiens; identical to SEQ ID NO: 798896

SEQ ID NO: 798900 - protein, 197 aa, Homo sapiens
MWRWRTRPSTVAPVASESWWCRPSSRGNRCFRDTLDPSMTIHCDMVITYGLDQLENCQTCGTNYIISVLNLLTLIVEQINTKLPSSFVEKLFIPSSKLLFLRYHKEKEVVAVAHAVYQAMLSLKNIPVLETAYKLILGEMTCALNNLLHSLQLPEACSEIKHEAFKNHVFNVDNAKFVVKFDLSALTTIGNAKNSSL

SEQ ID NO: 798901 - protein, 193 aa, Homo sapiens; identical to SEQ ID NO: 798896

SEQ ID NO: 798902 - protein, 159 aa, Homo sapiens
MTIHCDMVITYGLDQLENCQTCGTNYIISVLNLLTLIVEQINTKLPSSFVEKLFIPSSKLLFLRYHKEKEVVAVAHAVYQAMLSLKNIPVLETAYKLILGEMTCALNNLLHSLQLPEACSEIKHEAFKNHVFNVDNAKFVVKFDLSALTTIGNAKNSSL

SEQ ID NO: 798903 - protein, 193 aa, Homo sapiens; identical to SEQ ID NO: 798896

SEQ ID NO: 798904 - protein, 193 aa, Homo sapiens; identical to SEQ ID NO: 798896

SEQ ID NO: 798905 - protein, 185 aa, Homo sapiens; identical to SEQ ID NO: 798895

SEQ ID NO: 798906 - protein, 185 aa, Homo sapiens; identical to SEQ ID NO: 798895

SEQ ID NO: 798907 - protein, 185 aa, Homo sapiens; identical to SEQ ID NO: 798895

SEQ ID NO: 798908 - protein, 193 aa, Homo sapiens; identical to SEQ ID NO: 798896

SEQ ID NO: 798909 - protein, 193 aa, Homo sapiens; identical to SEQ ID NO: 798896

SEQ ID NO: 798910 - protein, 185 aa, Homo sapiens; identical to SEQ ID NO: 798895

SEQ ID NO: 798911 - protein, 193 aa, Homo sapiens; identical to SEQ ID NO: 798896

SEQ ID NO: 798912 - protein, 347 aa, Homo sapiens
CRSPTAEPGLLSSRRARTIQHRLRRVPPSSGSDWLTHGKREKPGPLETRLLEERKYCVDVRLSKGGSEFSSEVAPVRQQGSVAGARAGVVSLLGCRSSWTAAMELSAEYLREKLQRDLEAEHVEVEDTTLNRCSCSFRVLVVSAKFEGKPLLQRHRLVNACLAEELPHIHAFEQKTLTPDQLGTLDPSMTIHCDMVITYGLDQLENCQTCGTNYIISVLNLLTLIVEQINTKLPSSFVEKLFIPSSKLLFLRYHKEKEVVAVAHAVYQAMLSLKNIPVLETAYKLILGEMTCALNNLLHSLQLPEACSEIKHEAFKNHVFNVDNAKFVVKFDLSALTTIGNAKNSSL

SEQ ID NO: 798913 - protein, 185 aa, Homo sapiens; identical to SEQ ID NO: 798895

SEQ ID NO: 798914 - protein, 114 aa, Homo sapiens
MTIHCDMVITYGLDQLENCQTCGTNYIISVLNLLTLIVEQINTKLPSSFVEKLFIPSSKLLFLRYHKEKEHAQLIFVFLMETGFHHVGQAGLELQTSSDPPTSASQSAGITGLS

SEQ ID NO: 798915 - protein, 105 aa, Homo sapiens
EWAGWGGVSLVWQGSYQGSSCQDAQPNSGLLQASVITLYTMFVTWSALSSIPGKYGPRLKEAWPRSWVSISLLWGWGPSQVTGTSLLQPILRLSPPMRWEGPVCS

SEQ ID NO: 798916 - protein, 108 aa, Homo sapiens
MGIEVRSYVHGHKAVVLKMSEMDWSYRVRARVEVRGHNWDIRPGAKMEVTRLGTRLMGKMVCSRPGETRKMISTWTAVWVKICASWAGLLLYLWTLVAPLLLRNRDFS

SEQ ID NO: 798917 - protein, 476 aa, Homo sapiens
DPEVRAPPRRRRAPKPGAAAMGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 798918 - protein, 456 aa, Homo sapiens
MGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 798919 - protein, 401 aa, Homo sapiens
MLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 798920 - protein, 468 aa, Homo sapiens
MGACLGACSLLSCASCLCGSAPCILCSCCPASRNSTVSRLIFTFFLFLGVPRCSHPYCLMPAVAFGKEVKAFFNLDGFGLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 798921 - protein, 300 aa, Homo sapiens
LVVLLSWWCCCPGGAAVLLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 798922 - protein, 476 aa, Homo sapiens; identical to SEQ ID NO: 798917

SEQ ID NO: 798923 - protein, 566 aa, Homo sapiens
MGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPGKYGPRLKEAWPRSWVSISLLWGWGPSQVTGTSLLQPILRLSPPMRWEGPVLFLSCLSALVTAERSVAVDLSGWLCICLSIRGGSLAILRATWLPRPGLHGLRVIVLPSPEQKCNPHLPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 798924 - protein, 401 aa, Homo sapiens
DPEVRAPPRRRRAPKPGAAAMGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQHHQDSSTTRTHTSS

SEQ ID NO: 798925 - protein, 350 aa, Homo sapiens
MGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFIRYGQVWILGKDRD

SEQ ID NO: 798926 - protein, 106 aa, Homo sapiens
MQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 798927 - protein, 190 aa, Homo sapiens
RRHQMAGCEAASAEVAVAQEEWGYQGPQVEEQPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 798928 - protein, 379 aa, Homo sapiens
DPEVRAPPRRRRAPKPGAAAMGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPQLSISDERAPLSSGSTGAGLLERAGNSHHSGASGTEALVFLITTPRKTDQIIDFVTIRISQNL

SEQ ID NO: 798929 - protein, 141 aa, Homo sapiens
MARKSLGVESAEVIFLLLHLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 798930 - protein, 456 aa, Homo sapiens; identical to SEQ ID NO: 798918

SEQ ID NO: 798931 - protein, 483 aa, Homo sapiens
DRLGGAGGISAEAAPRRRRAPKPGAAAMGACLGACSLLSCASCLCGSAPCILCSCCPASRNSTVSRLIFTFFLFLGVLVSIIMLSPGVESQLYKLPWVCEEGAGIPTVLQGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 798932 - protein, 456 aa, Homo sapiens; identical to SEQ ID NO: 798918

SEQ ID NO: 798933 - protein, 382 aa, Homo sapiens
AAAYYYYIRGHIDCGSLLGYRAVYRMCFATAAFFFFFTLLMLCVSSSRDPRAAIQNGFWFFKFLILVGLTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 798934 - protein, 111 aa, Homo sapiens
ICNGGLQWREGRGLPLLPLALGHPQLYQMSEHQESSIINEDTELGDAYVLRSWSLHTRSTSCCVMPVSKIRLCRRKLLPGTGGEGWGWGHLLAAPCPPSPPPLRLHQEPPP

SEQ ID NO: 798935 - protein, 139 aa, Homo sapiens
RNEIGDSEPLDSRDTWLINKDQIQDLSAKLKPYEKKDWRHAPRFVTPLKPHTVLRGQDCTMTCAFLGNPRPTVTLYKGDVNITANSKFWYNSTSGVCTLVIPTCTLKDSGDYSVLVENELGKDRSSCTLTVYDMRVLNP

SEQ ID NO: 798936 - protein, 155 aa, Homo sapiens
RNEIGDSEPLDSRDTWLINKDQIQDLSAKLKPYEKKDWRHAPRFVTPLKPHTVLRGQDCTMTCAFLGNPRPTVTLYKGDVNITANSKFWYNSTSGVCTLVIPTCTLKDSGDYSVLVENELGKDRSSCTLTVYDKDDKSVVASITESLQKKSKHLM

SEQ ID NO: 798937 - protein, 387 aa, Homo sapiens
VREDWKHVGVWLISAPGDKENLQALERMNTVTSKSNLSYNTKFAIPDFKVGTLDSLVGLSDELGKLDTFAESLIRRMAQSVVEVMEDSKGKVQEHLLANGVDLTSFVTHFEWDMAKYPVKQPLVSVVDTIAKQLAQIEMDLKSRTAAYNTLKTNLENLEKKSMGNLFTRTLSDIVSKEDFVLDSEYLVTLLVIVPKPNYSQWQKTYESLSDMVVPRSTKLITEDKEGGLFTVTLFRKVIEDFKTKAKENKFTVREFYYDEKEIEREREEMARLLSDKKQQYGPLLRWLKVNFSEAFIAWIHIKALRVFVESVLRYGLPVNFQAVLLQPHKKSSTKRLREVLNSVFRHLDEVAATSILDASVEIPGLQLNNQDYFPYVYFHIDLSLLD

SEQ ID NO: 798938 - protein, 433 aa, Homo sapiens
VREDWKHVGVWLISAPGDKENLQALERMNTVTSKSNLSYNTKFAIPDFKVGTLDSLVGLSDELGKLDTFAESLIRRMAQSVVEVMEDSKGKVQEHLLANGVDLTSFVTHFEWDMAKYPVKQPLVSVVDTIAKQLAQIEMDLKSRTAAYNTLKTNLENLEKKSMGNLFTRTLSDIVSKEDFVLDSEYLVTLLVIVPKPNYSQWQKTYESLSDMVVPRSTKLITEDKEGGLFTVTLFRKVIEDFKTKAKENKFTVREFYYDEKEIEREREEMARLLSDKKQQYQTSCVALKKGSSTFPDHKVKVTPLGNPDRPAAGQTDRERESEGEGEGPLLRWLKVNFSEAFIAWIHIKALRVFVESVLRYGLPVNFQAVLLQPHKKSSTKRLREVLNSVFRHLDEVAATSILDASVEIPGLQLNNQDYFPYVYFHIDLSLLD

SEQ ID NO: 798939 - protein, 331 aa, Homo sapiens
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPGLGAIPNCSLNPGRDGDLCHSTAVTPSGQFKEKH

SEQ ID NO: 798940 - protein, 329 aa, Homo sapiens
MIICYISWSTLHFRCHIIGNYDDDDDDDDDTLILDSISKLNNDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPGLGAIPNCSLNPGRDGDLCHSTAVTPSGQFKEKH

SEQ ID NO: 798941 - protein, 207 aa, Homo sapiens
MVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPGLGAIPNCSLNPGRDGDLCHSTAVTPSGQFKEKH

SEQ ID NO: 798942 - protein, 276 aa, Homo sapiens
PPIPPCCPKYTYKTQTSVLLVRPAIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPGLGAIPNCSLNPGRDGDLCHSTAVTPSGQFKEKH

SEQ ID NO: 798943 - protein, 373 aa, Homo sapiens
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPDVMVVGEPTLMGGEFGDEDERLITRLENTQYDAANGMDDEEDFNNSPALGNNSPWNSKPPATQETKSENPPPQASQ

SEQ ID NO: 798944 - protein, 331 aa, Homo sapiens; identical to SEQ ID NO: 798939

SEQ ID NO: 798945 - protein, 349 aa, Homo sapiens
MVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPDVMVVGEPTLMGGEFGDEDERLITRLENTQYDAANGMDDEEDFNNSPALGNNSPWNSKPPATQETKSENPPPQASQ

SEQ ID NO: 798946 - protein, 116 aa, Homo sapiens
MIICYISWSTLHFRCHIIGNYDDDDDDDDDTLILDSISKLNNDSDNLWWDAFATEFFEDDATLTLSFCLEDGPKRYRTKNLRPIGEKMNINGKWCCCQNLLFGDWRRELFYTIKNY

SEQ ID NO: 798947 - protein, 331 aa, Homo sapiens; identical to SEQ ID NO: 798939

SEQ ID NO: 798948 - protein, 192 aa, Homo sapiens
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHVVCNIGANAGTDVET

SEQ ID NO: 798949 - protein, 359 aa, Homo sapiens
MSSTPHDPFYSSPFGPFYRRHTPYMVQPEYRIYEMNKRLQSRTEGHIIGNYDDDDDDDDDTLILDSISKLNNDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPGLGAIPNCSLNPGRDGDLCHSTAVTPSGQFKEKH

SEQ ID NO: 798950 - protein, 256 aa, Homo sapiens
FYKESNMCFLFQFCLFYSIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRLPEDLLVSEVAEDGGSASRTHKATNNQTEKKEKFHQQHFQQQRWEQCKQHWQQEEDHSCKPESVQSGTWARSDPELQPQPWEGWRPVSFNSSDPFWPI

SEQ ID NO: 798951 - protein, 744 aa, Homo sapiens
MDSVAFEDVAVNFTHEEWALLGPSQKNLYRDVMRETIRNLNCIGMKWENQNIDDQHQNLRRNPRCDVVERFGKSKDGSQCGETLSQIRNSIVNKNTPARVDACGSSVNGEVIMGHSSLNCYIRVDTGHKHRECHEYAEKSYTHKQCGKGLSYRHSFQTCERPHTGKKPYDCKECGKTFSSPGNLRRHMVVKGGDGPYKCELCGKAFFWPSLLRMHERTHTGEKPYECKQCSKAFPVYSSYLRHEKIHTGEKPYECKQCSKAFPDYSSYLRHERTHTGEKPYKCKQCGKAFSVSGSLRVHERIHTGEKPYTCKQCGKAFCHLGSFQRHMIMHSGDGPHKCKICGKGFDFPGSARIHEGTHTLEKPYECKQCGKLLSHRSSFRRHMMAHTGDGPHKCTVCGKAFDSPSVFQRHERTHTGEKPYECKQCGKAFRTSSSLRKHETTHTGEQPYKCKCGKAFSDLFSFQSHETTHSEEEPYECKECGKAFSSFKYFCRHERTHSEEKSYECQICGKAFSRFSYLKTHERTHTAEKPYECKQCRKAFFWPSFLLRHERTHTGERPYECKHCGKAFSRSSFCREHERTHTGEKPYEYSVTFEDVAVNFTQEEWTLLDPSQKKLYRDVMWETFRNLATIGTKQKEWNIEEQYKNQGRNLRNHMVERLCESKEGSHGGEGFSQIANLSLNKKTPSGGKLWESSVCGKVLSHHSSLNRHIRSYTRHKLYKCQEYGEKPYKCKKCGKPFSYLQSL

SEQ ID NO: 798952 - protein, 80 aa, Homo sapiens
RVPENCQSGARQRGGCDVPGASGLFTLVTSVPYSVTERRPGTSVVAFVALGPTLTTGVGRTRDTAQPGNGPVLWNFLGLP

SEQ ID NO: 798953 - protein, 154 aa, Homo sapiens
MALCYGTFWGYPKMLEAANLMEGLVDIGPWVTLPRGQPEVLEWGLPKDQDSVAFEDVAVNFTHEEWALLGPSQKNLYRDVMRETIRNLNCIGMKWENQNIDDQHQNLRRNPRLSETWLQNFILIHYGHLVALSDGGLLQFSTGQGLPVTQAGVQ

SEQ ID NO: 798954 - protein, 617 aa, Homo sapiens
MFQDSVAFEDVAVNFTHEEWALLGPSQKNLYRDVMRETIRNLNCIGMKWENQNIDDQHQNLRRNPRCDVVERFGKSKDGSQCGETLSQIRNSIVNKNTPARVDACGSSVNGEVIMGHSSLNCYIRVDTGHKHRECHEYAEKSYTHKQCGKGLSYRHSFQTCERPHTGKKPYDCKECGKTFSSPGNLRRHMVVKGGDGPYKCELCGKAFFWPSLLRMHERTHTGEKPYECKQCSKAFPVYSSYLRHEKIHTGEKPYECKQCSKAFPDYSSYLRHERTHTGEKPYKCKQCGKAFSVSGSLRVHERIHTGEKPYTCKQCGKAFCHLGSFQRHMIMHSGDGPHKCKICGKGFDFPGSARIHEGTHTLEKPYECKQCGKLLSHRSSFRRHMMAHTGDGPHKCTVCGKAFDSPSVFQRHERTHTGEKPYECKQCGKAFRTSSSLRKHETTHTGEQPYKCKCGKAFSDLFSFQSHETTHSEEEPYECKECGKAFSSFKYFCRHERTHSEEKSYECQICGKAFSRFSYLKTHERTHTAEKPYECKQCRKAFFWPSFLLRHERTHTGERPYECKHCGKAFSRSSFCREHERTHTGEKPYECKECGKAFSSLSSFNRHKRTHWKDIL

SEQ ID NO: 798955 - protein, 157 aa, Homo sapiens
MALCYGTFWGYPKMLEAANLMEGLVDIGPWVTLPRGQPEVLEWGLPKDQDSVAFEDVAVNFTHEEWALLGPSQKNLYRDVMRETIRNLNCIGMKWENQNIDDQHQNLRRNPRVAACYMQEDWFQYTLSIPKSTDASSFIKWNIRMYLPTFSVYSINV

SEQ ID NO: 798956 - protein, 121 aa, Homo sapiens
MFQDSVAFEDVAVNFTHEEWALLGPSQKNLYRDVMRETIRNLNCIGMKWENQNIDDQHQNLRRNPREVACHIAKDWSQYTGCPHLPNSLFPFILSELCKYSATFSGFFKLTFAKKKSITQR

SEQ ID NO: 798957 - protein, 323 aa, Homo sapiens
MKPVHERSQECLPPKKRDLPVTSEDMGRTTSCSTNHTPSSDASEWSRGVVVAGQSQAGARVSLGGDGAEAITGLTVDQYGMLYKVAVPPATFSPTGLPSVVNMSPLPPTFNVASSLIQHPGIHYPPLHYAQLPSTSLQFIGSPYSLPYAVPPNFLPSPLLSPSANLATSHLPHFVPYASLLAEGATPPPQAPSPAHSFNKAPSATSPSGQLPHHSSTQPLDLAPGRMPIYYQMSRLPAGYTLHETPPAGASPVLTPQESQSALEAAAANGGQRPRERNLVRRESEALDSPNSKGEGQGLVPVVECVVDGQLFSGSQTPRVEVA

SEQ ID NO: 798958 - protein, 140 aa, Homo sapiens
MKPVHERSQECLPPKKRDLPVTSEDMGRTTSCSTNHTPSSDASEWSRGVVVAGQSQAGARVSLGGDGAEAITGLTVDQYGMLYKVAVPPATFSPTGLPSVVNMSPLPPTFNVASSLIQHPGIHYPPLHYAQRSWTVHDPG

SEQ ID NO: 798959 - protein, 1687 aa, Homo sapiens [sequence omitted]

SEQ ID NO: 798960 - protein, 104 aa, Homo sapiens
KLFILTNKFMGGGGGGGGGGGGGGGDGGGRGGGGGGGGGGGGEERRAKQKFQVVKHVRRHHPDQADPNQGVGKDPTTPTVHLHDVQLEDPSPPAPAAPHTGPEG

SEQ ID NO: 798961 - protein, 1687 aa, Homo sapiens [sequence omitted]

SEQ ID NO: 798962 - protein, 1645 aa, Homo sapiens
MTDPLLDSQPASSTGEMDGLCPELLLIPPPLSNRGILGPVQSPCPSRDPAPIPTEPGCLLVEATATEEGPGNMEIIVETVAGTLTPGAPGETPAPKLPPGEREPSQEAGTPLPGQETAEEENVEKEEKSDTQKDSQKAVDKGQGAQRLEGDVVSGTESLFKTHMCPECKRCFKKRTHLVEHLHLHFPDPSLQCPNCQKFFTSKSKLKTHLLRELGEKAHHCPLCHYSAVERNALNRHMASMHEDISNFYSDTYACPVCREEFRLSQALKEHLKSHTAAAAAEPLPLRCFQEGCSYAAPDRKAFIKHLKETHGVRAVECRHHSCPMLFATAEAMEAHHKSHYAFHCPHCDFACSNKHLFRKHKKQGHPGSEELRCTFCPFATFNPVAYQDHVGKMHAHEKIHQCPECNFATAHKRVLIRHMLLHTGEKPHKCELCDFTCRDVSYLSKHMLTHSNTKDYMCTECGYVTKWKHYLRVHMRKHAGDLRYQCNQCSYRCHRADQLSSHKLRHQGKSLMCEVCAFACKRKYELQKHMASQHHPGTPAPLYPCHYCSYQSRHKQAVLSHENCKHTRLREFHCALCDYRTFSNTTLLFHKRKAHGYVPGDQAWQLRYASQEPEGAMQGPTPPPDSEPSNQLSARPEGPGHEPGTVVDPSLDQALPEMSEEVNTGRQEGSEAPHGGDLGGSPSPAEVEEGSCTLHLEALGVELESVTEPPLEEVTETAPMEFRPLGLEGPDGLEGPELSSFEGIGTSDLGAEENPLLEKPVSEPSTNPPSLEEAPNNWVGTFKTTPPAETAPLPPLPESESLLKALRRQDKEQAEALVLEGRVQMVVIQGEGRAFRCPHCPFITRREKALNLHSRTGCQGRREPLLCPECGASFKQQRGLSTHLLKKCPVLLRKNKGLPRPDSPIPLQPVLPGTQASEDTESGKPPPASQEAELLLPKDAPLELPREPEETEEPLATVSGSPVPPAGNSLPTEAPKKHCFDPVPPAGNSSPTEAPKKHHLDPVPPAGNSSPTEALKKHRFEQGKFHCNSCPFLCSRLSSITSHVAEGCRGGRGGGGKRGTPQTQPDVSPLSNGDSAPPKNGSTESSSGDGDTVLVQKQKGARFSCPTCPFSCQQERALRTHQIRGCHLQCGDCGFTCKQSRCMQQHRRLKHEGVKPHQCPFCDFSTTRRYRLEAHQSRHTGIGRIPCSSCPQTFGTNSKLRLHRLRVHDKTPTHFCPLCDYSGYLRHDITRHVNSCHQGTPAFACSQCEAQFSSETALKQHALRRHPEPAQPAPGSPAETTEGPLHCSRCGLLCPSPASLRGHTRKQHPRLECGACQEAFPSRLALDEHRRQQHFSHRCQLCDFAARERVGLVKHYLEQHEETSAAVAASDGDGDAGQPPLHCPFCDFTCRHQLVLDHHVKGHGGTRLYKCTDCAYSTKNRQKITWHSRIHTGEKPYHCHLCPYACADPSRLKYHMRIHKEERKYLCPECGYKCKWVNQLKYHMTKHTGLKPYQCPECEYCTNRADALRVHQETRHREARAFMCEQCGKAFKTRFLLRTHLRKHSEAKPYVCNVCHRAFRWAAGLRHHALTHTDRHPFFCRLCNYKAKQKFQVVKHVRRHHPDQADPNQGVGKDPTTPTVHLHDVQLEDPSPPAPAAPHTGPEG

SEQ ID NO: 798963 - protein, 189 aa, Homo sapiens
MRIHKEERKYLCPECGYKCKWVNQLKYHMTKHTGLKPYQCPECEYCTNRADALRVHQETRHREARAFMCEQCGKAFKTRFLLRTHLRKHSEAKPYVCNVCHRAFRWAAGLRHHALTHTDRHPFFCRLCNYKAKQKFQVVKHVRRHHPDQADPNQGVGKDPTTPTVHLHDVQLEDPSPPAPAAPHTGPEG

SEQ ID NO: 798964 - protein, 806 aa, Homo sapiens
MTDPLLDSQPASSTGEMDGLCPELLLIPPPLSNRGILGPVQSPCPSRDPAPIPTEPGCLLVEATATEEGPGNMEIIVETVAGTLTPGAPGETPAPKLPPGEREPSQEAGTPLPGQETAEEENVEKEEKSDTQKDSQKAVDKGQGAQRLEGDVVSGTESLFKTHMCPECKRCFKKRTHLVEHLHLHFPDPSLQCPNCQKFFTSKSKLKTHLLRELGEKAHHCPLCHYSAVERNALNRHMASMHEDISNFYSDTYACPVCREEFRLSQALKEHLKSHTAAAAAEPLPLRCFQEGCSYAAPDRKAFIKHLKETHGVRAVECRHHSCPMLFATAEAMEAHHKSHYAFHCPHCDFACSNKHLFRKHKKQGHPGSEELRCTFCPFATFNPVAYQDHVGKMHAHEKIHQCPECNFATAHKRVLIRHMLLHTGEKPHKCELCDFTCRDVSYLSKHMLTHSNTKDYMCTECGYVTKWKHYLRVHMRKHAGDLRYQCNQCSYRCHRADQLSSHKLRHQGKSLMCEVCAFACKRKYELQKHMASQHHPGTPAPLYPCHYCSYQSRHKQAVLSHENCKHTRLREFHCALCDYRTFSNTTLLFHKRKAHGYVPGDQAWQLRYASQEPEGAMQGPTPPPDSEPSNQLSARPEGPGHEPGTVVDPSLDQALPEMSEEVNTGRQEGSEAPHGGDLGGSPSPAEVEEGSCTLHLEALGVELESVTEPPLEEVTETAPMEFRPLGLEGPDGLEGPELSSFEGIGTSDLGAEENPLLEKPVSEPSTNPPSLEEAPNNWVGTFKTTPLLRQHPCPHYLSQSHYSRP

SEQ ID NO: 798965 - protein, 1687 aa, Homo sapiens [sequence omitted]

SEQ ID NO: 798966 - protein, 1687 aa, Homo sapiens [sequence omitted]

SEQ ID NO: 798967 - protein, 1687 aa, Homo sapiens [sequence omitted]

SEQ ID NO: 798968 - protein, 1503 aa, Homo sapiens
MTDPLLDSQPASSTGEMDGLCPELLLIPPPLSNRGILGPVQSPCPSRDPAPIPTEPGCLLVEATATEEGPGNMEIIVETVAGTLTPGAPGETPAPKLPPGEREPSQEAGTPLPGQETAEEENVEKEEKSDTQKDSQKAVDKGQGAQRLEGDVVSGTESLFKTHMCPECKRCFKKRTHLVEHLHLHFPDPSLQCPNCQKFFTSKSKLKTHLLRELGEKAHHCPLCHYSAVERNALNRHMASMHEDISNFYSDTYACPVCREEFRLSQALKEHLKSHTAAAAAEPLPLRCFQEGCSYAAPDRKAFIKHLKETHGVRAVECRHHSCPMLFATAEAMEAHHKSHYAFHCPHCDFACSNKHLFRKHKKQGHPGSEELRCTFCPFATFNPVAYQDHVGKMHAHEKIHQCPECNFATAHKRVLIRHMLLHTGEKPHKCELCDFTCRDVSYLSKHMLTHSNTKDYMCTECGYVTKWKHYLRVHMRKHAGDLRYQCNQCSYRCHRADQLSSHKLRHQGKSLMCEVCAFACKRKYELQKHMASQHHPGTPAPLYPCHYCSYQSRHKQAVLSHENCKHTRLREFHCALCDYRTFSNTTLLFHKRKAHGYVPGDQAWQLRYASQEPEGAMQGPTPPPDSEPSNQLSARPEGPGHEPGTVVDPSLDQALPEMSEEVNTGRQEGSEAPHGGDLGGSPSPAEVEEGSCTLHLEALGVELESVTEPPLEEVTETAPMEFRPLGLEGPDGLEGPELSSFEGIGTSDLGAEENPLLEKPVSEPSTNPPSLEEAPNNWVGTFKTTPPAETAPLPPLPESESLLKALRRQDKEQAEALVLEGRVQMVVIQGEGRAFRCPHCPFITRREKALNLHSRTGCQGRREPLLCPECGASFKQQRGLSTHLLKKCPVLLRKNKGLPRPDSPIPLQPVLPGTQASEDTESGKPPPASQEAELLLPKDAPLELPREPEETEEPLATVSGSPVPPAGNSLPTEAPKKHCFDPVPPAGNSSPTEAPKKHHLDPVPPAGNSSPTEALKKHRFEQGKFHCNSCPFLCSRLSSITSHVAEGCRGGRGGGGKRGTPQTQPDVSPLSNGDSAPPKNGSTESSSGDGDTVLVQKQKGARFSCPTCPFSCQQERALRTHQIRGCPLEESGELHCSLCPFTAPAATALRLHQKRRHPTAAPARGPRPHLQCGDCGFTCKQSRCMQQHRRLKHEGVKPHQCPFCDFSTTRRYRLEAHQSRHTGIGRIPCSSCPQTFGTNSKLRLHRLRVHDKTPTHFCPLCDYSGYLRHDITRHVNSCHQGTPAFACSQCEAQFSSETALKQHALRRHPEPAQPAPGSPAETTEGPLHCSRCGLLCPSPASLRGHTRKQHPRLECGACQEAFPSRLALDEHRRQQHFSHRCQLCDFAARERVGLVKHYLEQHEETSAAVAASDGDGDAGQPPLHCPFCDFTCRHQLVLDHHVKGHGGTRLYKCTDCAYSTKNRQKITWHSRIHTGEKPYHCHLCPYACADPSRLKVMSEDMG

SEQ ID NO: 798969 - protein, 105 aa, Homo sapiens
MLIEGWRSGAQPSTKLLAVCPARASCVLGSNPESKTFLTPPPNPGLSLLLQSLEILSSILTLLPRNCSQGLSKNPVSTTLGLAGLSRSDLVFPCPSFLCITYFTH

SEQ ID NO: 798970 - protein, 243 aa, Homo sapiens
GHSGDSDWLGRWADWLGRWVGEFPLPRAIGQVPKLSCMDSQQEDLRFPGMWVSLYFGILGLCSVITGGCIIFLHWRKNLRREEHAQQWVEVMRAATFTYSPLLYWINKRRRYGMNAAINTGPAPAVTKTETEVQNPDVLWDLDIPEGRSHADQDSNPKAEAPAPLQPALQLAPQQPQARSPFPLPIFQEVPFAPPLCNLPPLLNHSVSYPLATCPERNVLFHSLLNLAQEDHSFNAKPFPSEL

SEQ ID NO: 798971 - protein, 152 aa, Homo sapiens
MRAATFTYSPLLYWINKRRRYGMNAAINTGPAPAVTKTETEVQNPDVLWDLDIPEGRSHADQDSNPKAEAPAPLQPALQLAPQQPQARSPFPLPIFQEVPFAPPLCNLPPLLNHSVSYPLATCPERNVLFHSLLNLAQEDHSFNAKPFPSEL

SEQ ID NO: 798972 - protein, 207 aa, Homo sapiens
MWLPPHHLRAQFTLWVSLYFGILGLCSVITGGCIIFLHWRKNLRREEHAQQWVEVMRAATFTYSPLLYWINKRRRYGMNAAINTGPAPAVTKTETEVQNPDVLWDLDIPEGRSHADQDSNPKAEAPAPLQPALQLAPQQPQARSPFPLPIFQEVPFAPPLCNLPPLLNHSVSYPLATCPERNVLFHSLLNLAQEDHSFNAKPFPSEL

SEQ ID NO: 798973 - protein, 130 aa, Homo sapiens
MNAAINTGPAPAVTKTETEVQNPDVLWDLDIPEGRSHADQDSNPKAEAPAPLQPALQLAPQQPQARSPFPLPIFQEVPFAPPLCNLPPLLNHSVSYPLATCPERNVLFHSLLNLAQEDHSFNAKPFPSEL

SEQ ID NO: 798974 - protein, 72 aa, Homo sapiens
SVPLSVSNQKKNLTVRTRVRGCEDCRLLARPTPSSVRRWTGKATTVAWPYFLILTAFVCHERLHDLEPVNLR

SEQ ID NO: 798975 - protein, 105 aa, Homo sapiens
MFHSAAVPPAWSPGELTRVKRLPGRLVLAAAQPTCANTATGTGKSLERVEKHQTLNRCRERSDSCRARRGPYTKATTIIGLGRDGGKRGAKSPKHIHSLMCFSEL

SEQ ID NO: 798976 - protein, 82 aa, Homo sapiens
SMKEKLSLTKVKLLERELLLRLSRLPPLLKARSLQLGDVSEFMSDASDFRWVTGISTESSGPARSQEAGQEPAAHSAATAHS

SEQ ID NO: 798977 - protein, 37 aa, Homo sapiens
MGSLADISETEDSMEASCYCNVYIKSKVPQVKTMRKL

SEQ ID NO: 798978 - protein, 37 aa, Homo sapiens; identical to SEQ ID NO: 798977

SEQ ID NO: 798979 - protein, 199 aa, Homo sapiens
MNRGGGSPSAAANYLLCTNCRKVLRKDKRIRVSQPLTRGPSAFIPEKEVVQANTVDERTNFLVEEYSTSGRLDNITQVMSLHTQYLESFLRSQFYMLRMDGPLPLPYRHYIAIMAAARHQCSYLINMHVDEFLKTGGIAEWLNGLEYVPQRLKNLNEINKLLAHRPWLITKEHIQKLVKTGENNWSLPELVHACGTSWH

SEQ ID NO: 798980 - protein, 121 aa, Homo sapiens
MSLHTQYLESFLRSQFYMLRMDGPLPLPYRHYIAIMAAARHQCSYLINMHVDEFLKTGGIAEWLNGLEYVPQRLKNLNEINKLLAHRPWLITKEHIQKLVKTGENNWSLPELVHACGTSWH

SEQ ID NO: 798981 - protein, 122 aa, Homo sapiens
MTSPEIASLSWGQMKVKGSNTTYKDCKVWPGGSRTWDWRETGTEHSPGVQPADVKEVVEKGVQTLVIGRGMSEALKVPSSTVEYLKKHGIDVRVLQTEQAVKEYNALVAQGVRVGGVFHSTC

SEQ ID NO: 798982 - protein, 122 aa, Homo sapiens; identical to SEQ ID NO: 798981

SEQ ID NO: 798983 - protein, 104 aa, Homo sapiens
MTSPEIASLSWGQMKVKGSNTTYKDCKVWPGGSRTWDWRETGTEHSPGVQPADVKEVVEKGVQTLVIGRGMSEALKAPTQQLPSGVHVRAVVQFHLATASWHIL

SEQ ID NO: 798984 - protein, 122 aa, Homo sapiens; identical to SEQ ID NO: 798981

SEQ ID NO: 798985 - protein, 122 aa, Homo sapiens; identical to SEQ ID NO: 798981

SEQ ID NO: 798986 - protein, 141 aa, Homo sapiens
MRVEPSWPNQLLKTSVKFLMTSPEIASLSWGQMKVKGSNTTYKDCKVWPGGSRTWDWRETGTEHSPGVQPADVKEVVEKGVQTLVIGRGMSEALKVPSSTVEYLKKHGIDVRVLQTEQAVKEYNALVAQGVRVGGVFHSTC

SEQ ID NO: 798987 - protein, 122 aa, Homo sapiens; identical to SEQ ID NO: 798981

SEQ ID NO: 798988 - protein, 122 aa, Homo sapiens; identical to SEQ ID NO: 798981

SEQ ID NO: 798989 - protein, 151 aa, Homo sapiens
ADQLQGVFPGAVGERRSRSSAGSTSVKFLMTSPEIASLSWGQMKVKGSNTTYKDCKVWPGGSRTWDWRETGTEHSPGVQPADVKEVVEKGVQTLVIGRGMSEALKVPSSTVEYLKKHGIDVRVLQTEQAVKEYNALVAQGVRVGGVFHSTC

SEQ ID NO: 798990 - protein, 104 aa, Homo sapiens; identical to SEQ ID NO: 798983

SEQ ID NO: 798991 - protein, 117 aa, Homo sapiens
ADQLQGVFPGAVGERRSRSSAGSTSVKFLMTSPEIASLSWGQMKVKGSNTTYKDCKVWPGGSRTWDWRETGTEHSPGVQPADVKEVVEKGVQTLVIGRGMSEALKDGIQGAQLDLNC

SEQ ID NO: 798992 - protein, 122 aa, Homo sapiens; identical to SEQ ID NO: 798981

SEQ ID NO: 798993 - protein, 196 aa, Homo sapiens
LDRSSAGSFWRLGSPRPVGSHLTSVKFLMTSPEIASLSWGQMKVKGSNTTYKDCKVWPGGSRTWDWRETGTESLTLLPRLECSGAISAHCNLHLPGSCHSPASASQVAGTTGACHHTQHSPGVQPADVKEVVEKGVQTLVIGRGMSEALKVPSSTVEYLKKHGIDVRVLQTEQAVKEYNALVAQGVRVGGVFHSTC

SEQ ID NO: 798994 - protein, 1670 aa, Homo sapiens [sequence omitted]

SEQ ID NO: 798995 - protein, 1635 aa, Homo sapiens
MATAVETEACQPTDASWESGGGGDDEMKQALPELESSQQNGGGGGLNIAEPSGGAGREENAGAEAAQSLSHEQPQDSSEAGAAALPRGPEEPERPVRRSFQIPRKSREKKALFQPLTPGSREFEDVVNILHSSYLEPTSVTNFNYRRACLVHNELLEKEFTEKRRELKFDGRLDKELSESYAFLMVDRYQVQTICEKGLHVGQSKITILGSPSMGVYLSRYADLLQANPLDTGAMGDVVIFKIMKGKIKSIYDPMGVKSLESMLNKSALDPTPKHECHVSKNANRITSLLAYRAYELTQYYFYEYGFDELRRRPRHVCPYAVVSFTYKDDIQTPKFVPSSRSNSFNTDEKHRPEKLDVETVMSIDHLKQKIPPALFYKETYLGPNEVLKNGMYCSLYEVVEKTRIGSNMESLLQKLDREKLVLVKPLGDRGYLFLLSPYQMVPPYEYQTAKSRVLHALFLFQEPRSIVTSQKGSTNAAPQERHESMPDVLKIAQFLQFSLIQCRKEFKNISAINFHSVVEKYVSEFFKRGFGSGKREFIMFPYDSRLDDKKFLYSAPRNKSHIDTCLHAYIFRPEVYQLPICKLKELFEENRKLQQFSPLSDYEGQEEEMNGTKMKFGKRNNSRGEAIISGKQRSSHSLDYDKDRVKELINLIQCRKKSVGGDSDTEDMRSKTVLKRKLEDLPENMRKLAKTSNLSENCHLYEESPQPIGSLGHDADLRRQQQDTCNSGIADIHRLFNWLSETLANARHSDASLTDTVNKALGLSTDDAYEELRQKHEYELNSTPDKKDYEQPTCAKVENAQFKGTQSLLLEVDATSKYSVAISTSEVGTDHKLHLKEDPNLISVNNFEDCSLCPSVPIEHGFRRQQSKSNNVEETEIHWKLIPITGGNARSPEDQLGKHGEKQTPGMKSPEEQLVCVPPQEAFPNDPRVINRQRSSDYQFPSSPFTDTLKGTTEDDVLTGQVEEQCVPAAEAEPPAVSETTERTVLGEYNLFSRKIEEILKQKNVSYVSRVSTPIFSTQEKMKRLSEFIYSKTSKAGVQEFVDGLHEKLNTIIIKASAKGGNLPPVSPNDSGAKIASNPLERHVIPVSSSDFNNKHLLEPLCSDPLKDTNSDEQHSTSALTEVEMNQPQHATELMVTSDHIVPGDMAREPVEETTKSPSDVNISAQPALSNFISQLEPEVFNSLVKIMKDVQKNTVKFYIHEEEESVLCKEIKEYLIKLGNTECHPEQFLERRSKLDKLLIIIQNEDIAGFIHKIPGLVTLKKLPCVSFAGVDSLDDVKNHTYNELFVSGGFIVSDESILNPEVVTVENLKNFLTFLEELSTPEGKWQWKVHCKFQKKLKELGRLNAKALSLLTLLNVYQKKHLVEILSYHNCDSQTRNAPELDCLIRLQAQNIQQRHIVFLTEKNIKMLSSYTDNGIVVATAEDFMQNFKNLVGYHNSITEENLPQLGANENLESQSALLENDEKDEEDMSLDSGDEISHIEVCSNFHSEIWEKETKGSRGTDQKKNTQIELQSSPDVQNSLLEDKTYLDSEERTSIDIVCSEGENSNSTEQDSYSNFQVYHSQLNMSHQFSHFNVLTHQTFLGTPYALSSSQSQENENYFLSAYTESLDRDKSPPPLSWGKSDSSRPYSQEK

SEQ ID NO: 798996 - protein, 1397 aa, Homo sapiens
IPRKSREKKALFQPLTPGSREFEDVVNILHSSYLEPTSVTNFNYRRACLVHNELLEKEFTEKRRELKFDGRLDKELSESYAFLMVDRYQVQTICEKGLHVGQSKITILGSPSMDLEKLDVETVMSIDHLKQKIPPALFYKETYLGPNEVLKNGMYCSLYEVVEKTRIGSNMESLLQKLDREKLVLVKPLGDRGYLFLLSPYQMVPPYEYQTAKSRVLHALFLFQEPRSIVTSQKGSTNAAPQERHESMPDVLKIAQFLQFSLIQCRKEFKNISAINFHSVVEKYVSEFFKRGFGSGKREFIMFPYDSRLDDKKFLYSAPRNKSHIDTCLHAYIFRPEVYQLPICKLKELFEENRKLQQFSPLSDYEGQEEEMNGTKMKFGKRNNSRGEAIISGKQRSSHSLDYDKDRVKELINLIQCRKKSVGGDSDTEDMRSKTVLKRKLEDLPENMRKLAKTSNLSENCHLYEESPQPIGSLGHDADLRRQQQDTCNSGIADIHRLFNWLSETLANARHSDASLTDTVNKALGLSTDDAYEELRQKHEYELNSTPDKKDYEQPTCAKVENAQFKGTQSLLLEVDATSKYSVAISTSEVGTDHKLHLKEDPNLISVNNFEDCSLCPSVPIEHGFRRQQSKSNNVEETEIHWKLIPITGGNARSPEDQLGKHGEKQTPGMKSPEEQLVCVPPQEAFPNDPRVINRQRSSDYQFPSSPFTDTLKGTTEDDVLTGQVEEQCVPAAEAEPPAVSETTERTVLGEYNLFSRKIEEILKQKNVSYVSRVSTPIFSTQEKMKRLSEFIYSKTSKAGVQEFVDGLHEKLNTIIIKASAKGGNLPPVSPNDSGAKIASNPLERHVIPVSSSDFNNKHLLEPLCSDPLKDTNSDEQHSTSALTEVEMNQPQHATELMVTSDHIVPGDMAREPVEETTKSPSDVNISAQPALSNFISQLEPEVFNSLVKIMKDVQKNTVKFYIHEEEESVLCKEIKEYLIKLGNTECHPEQFLERRSKLDKLLIIIQNEDIAGFIHKIPGLVTLKKLPCVSFAGVDSLDDVKNHTYNELFVSGGFIVSDESILNPEVVTVENLKNFLTFLEELSTPEGKWQWKVHCKFQKKLKELGRLNAKALSLLTLLNVYQKKHLVEILSYHNCDSQTRNAPELDCLIRLQAQNIQQRHIVFLTEKNIKMLSSYTDNGIVVATAEDFMQNFKNLVGYHNSITEENLPQLGANENLESQSALLENDEKDEEDMSLDSGDEISHIEVCSNFHSEIWEKETKGSRGTDQKKNTQIELQSSPDVQNSLLEDKTYLDSEERTSIDIVCSEGENSNSTEQDSYSNFQVYHSQLNMSHQFSHFNVLTHQTFLGTPYALSSSQSQENENYFLSAYTESLDRDKSPPPLSWGKSDSSRPYSQEK

SEQ ID NO: 798997 - protein, 1609 aa, Homo sapiens
MATAVETEACQPTDASWESGGGGDDEMKQALPELESSQQNGGGGGLNIAEPSGGAGREENAGAEAAQSLSHEQPQDSSEAGAAALPRGPEEPERPVRRSFQIPRKSREKKALFQPLTPGSREFEDVVNILHSSYLEPTSVTNFNYRRACLVHNELLEKEFTEKRRELKFDGRLDKELSESYAFLMVDRYQVQTICEKGLHVGQSKITILGSPSMGVYLSRYADLLQANPLDTGAMGDVVIFKIMKGKIKSIYDPMGVKSLESMLNKSALDPTPKHECHVSKNANRITSLLAYRAYELTQYYFYEYGFDELRRRPRHVCPYAVVSFTYKDDIQTPKFVPSSRSNSFNTDRNIDKYNYTLWKGQLLNKGKLLCYISLRSATRAFLPIKLPEKLDVETVMSIDHLKQKIPPALFYKETYLGPNEVLKNGMYCSLYEVVEKTRIGSNMESLLQKLDREKLVLVKPLGDRGYLFLLSPYQMVPPYEYQTAKSRVLHALFLFQEPRSIVTSQKGSTNAAPQERHESMPDVLKIAQFLQFSLIQCRKEFKNISAINFHSVVEKYVSEFFKRGFGSGKREFIMFPYDSRLDDKKFLYSAPRNKSHIDTCLHAYIFRPEVYQLPICKLKELFEENRKLQQFSPLSDYEGQEEEMNGTKMKFGKRNNSRGEAIISGKQRSSHSLDYDKDRVKELINLIQCRKKSVGGDSDTEDMRSKTVLKRKLEDLPENMRKLAKTSNLSENCHLYEESPQPIGSLGHDADLRRQQQDTCNSGIADIHRLFNWLSETLANARHSDASLTDTVNKALGLSTDDAYEELRQKHEYELNSTPDKKDYEQPTCAKVENAQFKGTQSLLLEVDATSKYSVAISTSEVGTDHKLHLKEDPNLISVNNFEDCSLCPSVPIEHGFRRQQSKSNNVEETEIHWKLIPITDTLKGTTEDDVLTGQVEEQCVPAAEAEPPAVSETTERTVLGEYNLFSRKIEEILKQKNVSYVSRVSTPIFSTQEKMKRLSEFIYSKTSKAGVQEFVDGLHEKLNTIIIKASAKGGNLPPVSPNDSGAKIASNPLERHVIPVSSSDFNNKHLLEPLCSDPLKDTNSDEQHSTSALTEVEMNQPQHATELMVTSDHIVPGDMAREPVEETTKSPSDVNISAQPALSNFISQLEPEVFNSLVKIMKDVQKNTVKFYIHEEEESVLCKEIKEYLIKLGNTECHPEQFLERRSKLDKLLIIIQNEDIAGFIHKIPGLVTLKKLPCVSFAGVDSLDDVKNHTYNELFVSGGFIVSDESILNPEVVTVENLKNFLTFLEELSTPEGKWQWKVHCKFQKKLKELGRLNAKALSLLTLLNVYQKKHLVEILSYHNCDSQTRNAPELDCLIRLQAQNIQQRHIVFLTEKNIKMLSSYTDNGIVVATAEDFMQNFKNLVGYHNSITEENLPQLGANENLESQSALLENDEKDEEDMSLDSGDEISHIEVCSNFHSEIWEKETKGSRGTDQKKNTQIELQSSPDVQNSLLEDKTYLDSEERTSIDIVCSEGENSNSTEQDSYSNFQVYHSQLNMSHQFSHFNVLTHQTFLGTPYALSSSQSQENENYFLSAYTESLDRDKSPPPLSWGKSDSSRPYSQEK

SEQ ID NO: 798998 - protein, 164 aa, Homo sapiens [sequence omitted]

SEQ ID NO: 798999 - protein, 352 aa, Homo sapiens
MATAVETEACQPTDASWESGGGGDDEMKQALPELESSQQNGGGGGLNIAEPSGGAGREENAGAEAAQSLSHEQPQDSSEAGAAALPRGPEEPERPVRRSFQIPRKSREKKALFQPLTPGSREFEDVVNILHSSYLEPTSVTNFNYRRACLVHNELLEKEFTEKRRELKFDGRLDKELSESYAFLMVDRYQVQTICEKGLHVGQSKITILGSPSMGVYLSRYADLLQANPLDTGAMGDVVIFKIMKGKIKSIYDPMGVKSLESMLNKSALDPTPKHECHVSKNANRITSLLAYRAYELTQYYFYEYGFDELRRRPRHVCPYAVVSFTYKDDIQTPKFVPSSRINSFFSDRNIL

SEQ ID NO: 799000 - protein, 89 aa, Homo sapiens
IEIKVRTKNPVHPQVLLDTEGVSLNIQCFFFVVVFLFFFGDGVSLCRPSWSTVVQSHCKLCLPGSHHSPASTSRMAGTTGTHHHAWLTN

SEQ ID NO: 799001 - protein, 192 aa, Homo sapiens
MATAVETEACQPTDASWESGGGGDDEMKQALPELESSQQNGGGGGLNIAEPSGGAGREENAGAEAAQSLSHEQPQDSSEAGAAALPRGPEEPERPVRRSFQIPRKSREKKALFQPLTPGSREFEDVVNILHSSYLEPTSVTNFNYRRACLVHNELLEKEFTEKRRELKFDGRLDKELSESYAFLMVDRYQVS

SEQ ID NO: 799002 - protein, 1233 aa, Homo sapiens [sequence omitted]

SEQ ID NO: 799003 - protein, 1233 aa, Homo sapiens [sequence omitted]

SEQ ID NO: 799004 - protein, 1512 aa, Homo sapiens [sequence omitted]

SEQ ID NO: 799005 - protein, 1512 aa, Homo sapiens [sequence omitted]

SEQ ID NO: 799006 - protein, 442 aa, Homo sapiens
MATAVETEACQPTDASWESGGGGDDEMKQALPELESSQQNGGGGGLNIAEPSGGAGREENAGAEAAQSLSHEQPQDSSEAGAAALPRGPEEPERPVRRSFQIPRKSREKKALFQPLTPGSREFEDVVNILHSSYLEPTSVTNFNYRRACLVHNELLEKEFTEKRRELKFDGRLDKELSESYAFLMVDRYQVQTICEKGLHVGQSKITILGSPSMGVYLSRYADLLQANPLDTGAMGDVVIFKIMKGKIKSIYDPMGVKSLESMLNKSALDPTPKHECHVSKNANRITSLLAYRAYELTQYYFYEYGFDELRRRPRHVCPYAVVSFTYKDDIQTPKFVPSSRSNSFNTDRNIDKYNYTLWKGQLLNKGKLLCYISLRSATRAFLPIKLPEKLDVETVMSIDHLKQKIPPALFYKETYLGPNEVLKNGMYCSLYEVVEKTRIVK

SEQ ID NO: 799007 - protein, 596 aa, Homo sapiens
MATAVETEACQPTDASWESGGGGDDEMKQALPELESSQQNGGGGGLNIAEPSGGAGREENAGAEAAQSLSHEQPQDSSEAGAAALPRGPEEPERPVRRSFQIPRKSREKKALFQPLTPGSREFEDVVNILHSSYLEPTSVTNFNYRRACLVHNELLEKEFTEKRRELKFDGRLDKELSESYAFLMVDRYQVQTICEKGLHVGQSKITILGSPSMGVYLSRYADLLQANPLDTGAMGDVVIFKIMKGKIKSIYDPMGVKSLESMLNKSALDPTPKHECHVSKNANRITSLLAYRAYELTQYYFYEYGFDELRRRPRHVCPYAVVSFTYKDDIQTPKFVPSSRSNSFNTDRNIDKYNYTLWKGQLLNKGKLLCYISLRSATRAFLPIKLPEKLDVETVMSIDHLKQKIPPALFYKETYLGPNEVLKNGMYCSLYEVVEKTRIGSNMESLLQKLDREKLVLVKPLGDRGYLFLLSPYQMVPPYEYQTAKSRVLHALFLFQEPRSIVTSQKGSTNAAPQERHESMPDVLKIAQFLQFSLIQCRKEFKNISAINFHSVVEKYVSEFFKRGFGSGKREFIMFPYDSRLDDKKFLYSAPTSYW

SEQ ID NO: 799008 - protein, 188 aa, Homo sapiens [sequence omitted]

SEQ ID NO: 799009 - protein, 227 aa, Homo sapiens
PTLNPNPQGIQKSSGAPKSPPLFSAPLAPPLRAERVCALCPSAAPPRSSLPPKVPPHLHFSLTPKYPEESQYFLLSAASQILTVLSQWFSDFILPLGYLFGTLMSSPPSGHPDLTLTASPRLTLVLIDEPGVPGVKWLTVTDFIPSHHSEVVLPAWEQPRHCVLVAEDTLGCRVPGGCACIPLHDDVVSLTVLLHIWAVVPAICQVRWKIRWGKSQAAGVLESENYF

SEQ ID NO: 799010 - protein, 80 aa, Homo sapiens
VKWLTVTDFIPSHHSEVVLPAWEQPRHCVLVAEDTLGCRVPGGCACIPLHDDVVSLTVLLHIWAVVPGQSHCVGDFLKQP

SEQ ID NO: 799011 - protein, 357 aa, Homo sapiens
MTALPGPLWLLGLALCALGGGGPGLRPPPGCPQRRLGARERRDVQREILAVLGLPGRPRPRAPPAASRLPASAPLFMLDLYHAMAGDDDEDGAPAERRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVHGSHGRQVCRRHELYVSFQDLGWLDWVIAPQGYSAYYCEGECSFPLDSCMNATNHAILQSLEVQR

SEQ ID NO: 799012 - protein, 402 aa, Homo sapiens
MTALPGPLWLLGLALCALGGGGPGLRPPPGCPQRRLGARERRDVQREILAVLGLPGRPRPRAPPAASRLPASAPLFMLDLYHAMAGDDDEDGAPAERRLGRADLVMSFVNMVERDRALGHQEPHWKEFRFDLTQIPAGEAVTAAEFRIYKVPSIHLLNRTLHVSMFQVVQEQSNRESDLFFLDLQTLRAGDEGWLVLDVTAASDCWLLKRHKDLGLRLYVETEDGHSVDPGLAGLLGQRAPRSQQPFVVTFFRASPSPIRTPRAVRPLRRRQPKKSNELPQANRLPGIFDDVHGSHGRQVCRRHELYVSFQDLGWLDWVIAPQGYSAYYCEGECSFPLDSCMNATNHAILQSLVHLMKPDAVPKACCAPTKLSATSVLYYDSSNNVILRKHRNMVVKACGCH

SEQ ID NO: 799013 - protein, 402 aa, Homo sapiens; identical to SEQ ID NO: 799012

SEQ ID NO: 799014 - protein, 111 aa, Homo sapiens
GQERKGRAERVGACRLTGIARMADRAPRQPTSLGSSPQRCGSPPSAPPPPPDRGERIEDCLAPLCPPVVGGRGGCALSRFLPVDLSLLRSSRTAAVELVAGGVCRSPSQEN

SEQ ID NO: 799015 - protein, 157 aa, Homo sapiens
MPAQIVLLTVSEAEAEAESDESAGKWGRGGGRQAPPLPWVHGGSLPLVRRRPAVAGPLLWSWSQAVCAGRLVRRTSPRLTVREWTDTGIVPLRERSGTPDLQEVGSEASRTGAPPGGFLPGVELPTWDPRKIGVVVCFLLLLTLLGFLEFHTTVHMR

SEQ ID NO: 799016 - protein, 296 aa, Homo sapiens
MNRWYVKPLETSSSKVKAKTIVMIPDSQKLLRCELESLKSQLQAQTKAFEFLNHSVTMLEKESCLQQIKIQQLEEVLSPTGRQGEKEEHKWGMEQGRQELYGALTQGLQGLEKTLRDSEEMQRARTTRCLQLLAQEIRDSKKFLWEELELVREEVTFIYQKLQAQEDEISENLVNIQKMQKTQVKCRKILTKMKQQGHETAACPETEEIPQGASGCWKDDLQKELSDIWSAVHVLQNSIDSLTLCSGACPKASSLRGHKGHQCLSPPLPSWDSDSDSDQDLSQPPFSKSGRSFPPA

SEQ ID NO: 799017 - protein, 291 aa, Homo sapiens
MIPDSQKLLRCELESLKSQLQAQTKAFEFLNHSVTMLEKESCLQQIKIQQLEEVLSPTGRQGEKEEHKWGMEQGRQELYGALTQGLQGLEKTLRDSEEMQRARTTRCLQLLAQEIRDSKKFLWEELELVREEVTFIYQKLQAQEDEISENLVNIQKMQKTQVKCRKILTKMKQQGHETAACPETEEIPQGASGCWKDDLQKELSDIWSAVHVLQNSIDSLTLCSGACPKASSLRGHKGHQCLSPPLPSWDSDSDSDQDLSQPPFSKSGRSFPPGADPPQSPPPPISLLTCP

SEQ ID NO: 799018 - protein, 291 aa, Homo sapiens; identical to SEQ ID NO: 799017

SEQ ID NO: 799019 - protein, 229 aa, Homo sapiens [sequence omitted]

SEQ ID NO: 799020 - protein, 135 aa, Homo sapiens
MQKTQVKCRKILTKMKQQGHETAACPETEEIPQGASGCWKDDLQKELSDIWSAVHVLQNSIDSLTLCSGACPKASSLRGHKGHQCLSPPLPSWDSDSDSDQDLSQPPFSKSGRSFPPGADPPQSPPPPISLLTCP

SEQ ID NO: 799021 - protein, 214 aa, Homo sapiens
MNRWYVKPLETSSSKVKAKTIVMIPDSQKLLRCELESLKSQLQAQTKAFEFLNHSVTMLEKESCLQQIKIQQLEEVLSPTGRQGEKEEHKWGMEQGRQELYGALTQGLQGLEKTLRDSEEMQRARTTRCLQLLAQEIRDSKKFLWEELELVREEVTFIYQKLQAQEDEISENLVNIQKMQKTQVKCRKGLSQGLEPKRPQGAPVPEPSTPLLGL

SEQ ID NO: 799022 - protein, 141 aa, Homo sapiens
MNRWYVKPLETSSSKVKAKTIVMIPDSQKLLRCELESLKSQLQAQTKAFEFLNHSVTMLEKESCLQQIKIQQLEEVLSPTGRQGEKEEHKWGMEQGRQELYGALTQGLQGLEKTLRDSEEMQRARTTRCLQLLAQEIRDRS

SEQ ID NO: 799023 - protein, 313 aa, Homo sapiens
MNRWYVKPLETSSSKVKAKTIVMIPDSQKLLRCELESLKSQLQAQTKAFEFLNHSVTMLEKESCLQQIKIQQLEEVLSPTGRQGEKEEHKWGMEQGRQELYGALTQGLQGLEKTLRDSEEMQRARTTRCLQLLAQEIRDSKKFLWEELELVREEVTFIYQKLQAQEDEISENLVNIQKMQKTQVKCRKILTKMKQQGHETAACPETEEIPQGASGCWKDDLQKELSDIWSAVHVLQNSIDSLTLCSGACPKASSLRGHKGHQCLSPPLPSWDSDSDSDQDLSQPPFSKSGRSFPPGADPPQSPPPPISLLTCP

SEQ ID NO: 799024 - protein, 141 aa, Homo sapiens; identical to SEQ ID NO: 799022

SEQ ID NO: 799025 - protein, 203 aa, Homo sapiens
MIPDSQKLLRCELESLKSQLQAQTKAFEFLNHSVTMLEKESCLQQIKIQQLEEAQEDEISENLVNIQKMQKTQVKCRKILTKMKQQGHETAACPETEEIPQGASGCWKDDLQKELSDIWSAVHVLQNSIDSLTLCSGACPKASSLRGHKGHQCLSPPLPSWDSDSDSDQDLSQPPFSKSGRSFPPGADPPQSPPPPISLLTCP

SEQ ID NO: 799026 - protein, 127 aa, Homo sapiens
MNRWYVKPLETSSSKVKAKTIVMIPDSQKLLRCELESLKSQLQAQTKAFEFLNHSVTMLEKESCLQQIKIQQLEEVLSPTGRQGEKEEHKWGMEQGRQELYGALTQGLQGLEKTLRDSEGRMTSRRN

SEQ ID NO: 799027 - protein, 104 aa, Homo sapiens
MNRWYVALPRTRLWKRTAHWSRTPEPETLGCPASGDTVRTADCRPGWGSGPSPHEAAPSPSPDLQKQCCNDQDILKRHHNVAKVTPTRETPSMQKTTAIYCCGA

SEQ ID NO: 799028 - protein, 104 aa, Homo sapiens
MLHDCWGRGQNRGKLCSGGGTAPREHPEPEEHRDAADKEEDEVGDEEGSCRRERGRAEPHPGSSSASILSDPPPPTNPPSTILFLISLLTLSKGPLLPACSPEC

SEQ ID NO: 799029 - protein, 139 aa, Homo sapiens
QLARAGLGRPARSRGRWGGQSRFRPSLGWARSGRTGQQPHSHSEAPCPLPHFPPAHGARLGAAARAGLRSEPSGLPVKWRIGETFPSQAPPPHKPPTPTATSWRPQHTCRTWPCFWGSVAFGNERFRRNCPSDSRTQPY

SEQ ID NO: 799030 - protein, 81 aa, Homo sapiens
NLLEQGWVDRRAPGDGGGGSPGFGHRWGGLGAAAPGSNPTPTRRPPALSPTSPRPMVRGWEPPPGLDCVLTTQGVSNLAVP

SEQ ID NO: 799031 - protein, 544 aa, Homo sapiens
MRSRHPRRAISEGHKSEGTMPPNKEASGLSSSPAGLICLPPISEELQLVWTQAAQTSELDSNEHLLKTFSYFPYPSLADIALLCLRYGLQMEKVKTWFMAQRLRCGISWSSEEIEETRARVVYRRDQLHFKSLLSFTHHAGRPPEEVPPPPVPAPEQVGIGIGPPTLSKPTQTKGLKVEPEEPSQMPPLPQSHQKLKESLMTPGSGAFPYQSDFWQHLQSSGLSKEQAGRGPNQSHGIGTASWNHSTTVPQPQARDKPPPIALIASSCKEESASSVTPSSSSTSSSFQVLANGATAASKPLQPLGCVPQSVSPSEQALPPHLEPAWPQGLRHNSVPGRVGPTEYLSPDMQRQRKTKRKTKEQLAILKSFFLQCQWARREDYQKLEQITGLPRPEIIQWFGDTRYALKHGQLKWFRDNAVPGAPSFQDPAIPTPPPSTRSLNERAETPPLPIPPPPPDIQPLERYWAAHQQLRETDIPQLSQASRLSTQQVLDWFDSRLPQPAEVVVCLDEEEEEEEEELPEDDEEEEEEEEDDDDDDDDVIIQD

SEQ ID NO: 799032 - protein, 579 aa, Homo sapiens
NLLEQGWVDRRAPGDGGGGSPGFGHRWGGLGAAAPGSNPTPTRRPPALSPTSPRPMVRGWEPPPGLDCAISEGHKSEGTMPPNKEASGLSSSPAGLICLPPISEELQLVWTQAAQTSELDSNEHLLKTFSYFPYPSLADIALLCLRYGLQMEKVKTWFMAQRLRCGISWSSEEIEETRARVVYRRDQLHFKSLLSFTHHAGRPPEEVPPPPVPAPEQVGIGIGPPTLSKPTQTKGLKVEPEEPSQMPPLPQSHQKLKESLMTPGSGAFPYQSDFWQHLQSSGLSKEQAGRGPNQSHGIGTASWNHSTTVPQPQARDKPPPIALIASSCKEESASSVTPSSSSTSSSFQVLANGATAASKPLQPLGCVPQSVSPSEQALPPHLEPAWPQGLRHNSVPGRVGPTEYLSPDMQRQRKTKRKTKEQLAILKSFFLQCQWARREDYQKLEQITGLPRPEIIQWFGDTRYALKHGQLKWFRDNAVPGAPSFQDPAIPTPPPSTRSLNERAETPPLPIPQLSQASRLSTQQVLDWFDSRLPQPAEVVVCLDEEEEEEEEELPEDDEEEEEEEEDDDDDDDDVIIQD

SEQ ID NO: 799033 - protein, 70 aa, Homo sapiens
NLLEQGWVDRRAPGDGGGGSPGFGHRWGGLGAAAPGSNPTPTRRPPALSPTSPRPMVRGWEPPPGLDCGE

SEQ ID NO: 799034 - protein, 604 aa, Homo sapiens
NLLEQGWVDRRAPGDGGGGSPGFGHRWGGLGAAAPGSNPTPTRRPPALSPTSPRPMVRGWEPPPGLDCAISEGHKSEGTMPPNKEASGLSSSPAGLICLPPISEELQLVWTQAAQTSELDSNEHLLKTFSYFPYPSLADIALLCLRYGLQMEKVKTWFMAQRLRCGISWSSEEIEETRARVVYRRDQLHFKSLLSFTHHAGRPPEEVPPPPVPAPEQVGIGIGPPTLSKPTQTKGLKVEPEEPSQMPPLPQSHQKLKESLMTPGSGAFPYQSDFWQHLQSSGLSKEQAGRGPNQSHGIGTASWNHSTTVPQPQARDKPPPIALIASSCKEESASSVTPSSSSTSSSFQVLANGATAASKPLQPLGCVPQSVSPSEQALPPHLEPAWPQGLRHNSVPGRVGPTEYLSPDMQRQRKTKRKTKEQLAILKSFFLQCQWARREDYQKLEQITGLPRPEIIQWFGDTRYALKHGQLKWFRDNAVPGAPSFQDPAIPTPPPSTRSLNERAETPPLPIPPPPPDIQPLERYWAAHQQLRETDIPQLSQASRLSTQQVLDWFDSRLPQPAEVVVCLDEEEEEEEEELPEDDEEEEEEEEDDDDDDDDVIIQD

SEQ ID NO: 799035 - protein, 565 aa, Homo sapiens
RRIKIKDGDATGHDISEGRRSYRAYGLLGIQEPTTRSSHRLNGAGGLTAELPRMAQSALYAAHHALRCAGQDTHGDRGELDSNEHLLKTFSYFPYPSLADIALLCLRYGLQMEKVKTWFMAQRLRCGISWSSEEIEETRARVVYRRDQLHFKSLLSFTHHAGRPPEEVPPPPVPAPEQVGIGIGPPTLSKPTQTKGLKVEPEEPSQMPPLPQSHQKLKESLMTPGSGAFPYQSDFWQHLQSSGLSKEQAGRGPNQSHGIGTASWNHSTTVPQPQARDKPPPIALIASSCKEESASSVTPSSSSTSSSFQVLANGATAASKPLQPLGCVPQSVSPSEQALPPHLEPAWPQGLRHNSVPGRVGPTEYLSPDMQRQRKTKRKTKEQLAILKSFFLQCQWARREDYQKLEQITGLPRPEIIQWFGDTRYALKHGQLKWFRDNAVPGAPSFQDPAIPTPPPSTRSLNERAETPPLPIPPPPPDIQPLERYWAAHQQLRETDIPQLSQASRLSTQQVLDWFDSRLPQPAEVVVCLDEEEEEEEEELPEDDEEEEEEEEDDDDDDDDVIIQD

SEQ ID NO: 799036 - protein, 188 aa, Homo sapiens
FSISAPPTLLFPSLPPFRFRRSRLLSAELFSEPVGGREGGVEELGFAGARAAAPLPESSGALERRRNKTAGGREREGRMEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGEQLCSSPI

SEQ ID NO: 799037 - protein, 593 aa, Homo sapiens
FSISAPPTLLFPSLPPFRFRRSRLLSAELFSEPVGGREGGVEELGFAGARAAAPLPESSGALERRRNKTAGGREREGRMEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQPPPHFQSPGAAPQGGGGGDSNPNPPPQCSFDLTPYKTAEHHKDICLTVTTSTIQVEHLASS

SEQ ID NO: 799038 - protein, 593 aa, Homo sapiens
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGEQLCSSPSEVLIFHDQYPRLEGSKDMGSGYVFDYSIKFLLSAYCVPSNVLGIVGDDKEVEDAVPAFEEVTFFPSLNQGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQPPPHFQSPGAAPQGGGGGDSNPNPPPQCSFDLTPYKTAEHHKDICLTVTTSTIQVEHLASS

SEQ ID NO: 799039 - protein, 576 aa, Homo sapiens [sequence omitted]

SEQ ID NO: 799040 - protein, 667 aa, Homo sapiens
FSISAPPTLLFPSLPPFRFRRSRLLSAELFSEPVGGREGGVEELGFAGARAAAPLPGECKGRAARRGGHPLPRAPALRVSRARSVRVSVWVCLAPEVRARALRLALFPLPRPFLVLPPSSAPSFPSKRRPSRALAQALAPPQPSPPESSGALERRRNKTAGGREREGRMEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQPPPHFQSPGAAPQGGGGGDSNPNPPPQCSFDLTPYKTAEHHKDICLTVTTSTIQVEHLASS

SEQ ID NO: 799041 - protein, 370 aa, Homo sapiens
MIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQPPPHFQSPGAAPQGGGGGDSNPNPPPQCSFDLTPYKTAEHHKDICLTVTTSTIQVEHLASS

SEQ ID NO: 799042 - protein, 490 aa, Homo sapiens
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQPPPHFQSPGAAPQGGGGFHSYYFLLIFIIYFVRPLF

SEQ ID NO: 799043 - protein, 338 aa, Homo sapiens
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSLITSEFR

SEQ ID NO: 799044 - protein, 125 aa, Homo sapiens
MRKHNPPDLQQQVQAAAAAAAVAQAQAQAQAQAQAQAQAQAQAQASQASQQQQQQQQQQQQQQQPPPHFQSPGAAPQGGGGGDSNPNPPPQCSFDLTPYKTAEHHKDICLTVTTSTIQVEHLASS

SEQ ID NO: 799045 - protein, 159 aa, Homo sapiens
MIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTR

SEQ ID NO: 799046 - protein, 515 aa, Homo sapiens [sequence omitted]

SEQ ID NO: 799047 - protein, 546 aa, Homo sapiens
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRSEGNCGTGNGQSLGLMDSVPGSTTNLLCDPGCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQPPPHFQSPGAAPQGGGGGDSNPNPPPQCSFDLTPYKTAEHHKDICLTVTTSTIQVEHLASS

SEQ ID NO: 799048 - protein, 683 aa, Homo sapiens
FSISAPPTLLFPSLPPFRFRRSRLLSAELFSEPVGGREGGVEELGFAGARAAAPLPGECKGRAARRGGHPLPRAPALRVSRARSVRVSVWVCLAPEVRARALRLALFPLPRPFLVLPPSSAPSFPSKRRPSRALAQALAPPQPSPPESSGALERRRNKTAGGREREGRMEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQPPPHFQSPGAAPQGGGGGDSNPNPPPQCSFDLTPYKTAEHHKDICLTVTTSTIQVEHLASS

SEQ ID NO: 799049 - protein, 515 aa, Homo sapiens [sequence omitted]

SEQ ID NO: 799050 - protein, 125 aa, Homo sapiens; identical to SEQ ID NO: 799044

SEQ ID NO: 799051 - protein, 125 aa, Homo sapiens; identical to SEQ ID NO: 799044

SEQ ID NO: 799052 - protein, 69 aa, Homo sapiens
RRSARGGGGVLARVFHTRLPGVRELTRGVVISRGKAGRKKKRRQKKKRLLSGQKVTMPSGQTFVSGEVG

SEQ ID NO: 799053 - protein, 123 aa, Homo sapiens [sequence omitted]

SEQ ID NO: 799054 - protein, 177 aa, Homo sapiens
DGGEKAFTLALLAFSLGPSSCSQMWGLSGQSFGRTLTPTLKMRSTWGCCSRTLFSASADTAKRSGDAGRAPQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPL

SEQ ID NO: 799055 - protein, 177 aa, Homo sapiens; identical to SEQ ID NO: 799054

SEQ ID NO: 799056 - protein, 370 aa, Homo sapiens
MSRRKQTNPNKVHCDSEGDEEETTQDEVSSHTSEEDGGVVKVEKELENTEQPVGGNEVVEHEVTGNLNSDPLLELCQCPLCQLDCGSREQLIAHVYQHTAAVVSAKSYMCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAFEEQNSSSLH

SEQ ID NO: 799057 - protein, 209 aa, Homo sapiens
MESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAFEEQNSSSLH

SEQ ID NO: 799058 - protein, 209 aa, Homo sapiens; identical to SEQ ID NO: 799057

SEQ ID NO: 799059 - protein, 412 aa, Homo sapiens
MSRRKQTNPNKVHWDQVFAGLEEQARQAMMKTDFPGDLGSQRQAIQQLRDQDSSSSDSEGDEEETTQDEVSSHTSEEDGGVVKVEKELENTEQPVGGNEVVEHEVTGNLNSDPLLELCQCPLCQLDCGSREQLIAHVYQHTAAVVSAKSYMCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAFEEQNSSSLH

SEQ ID NO: 799060 - protein, 262 aa, Homo sapiens
MCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAFEEQNSSSLH

SEQ ID NO: 799061 - protein, 412 aa, Homo sapiens; identical to SEQ ID NO: 799059

SEQ ID NO: 799062 - protein, 370 aa, Homo sapiens; identical to SEQ ID NO: 799056

SEQ ID NO: 799063 - protein, 370 aa, Homo sapiens; identical to SEQ ID NO: 799056

SEQ ID NO: 799064 - protein, 262 aa, Homo sapiens; identical to SEQ ID NO: 799060

SEQ ID NO: 799065 - protein, 209 aa, Homo sapiens; identical to SEQ ID NO: 799057

SEQ ID NO: 799066 - protein, 209 aa, Homo sapiens; identical to SEQ ID NO: 799057

SEQ ID NO: 799067 - protein, 412 aa, Homo sapiens; identical to SEQ ID NO: 799059

SEQ ID NO: 799068 - protein, 462 aa, Homo sapiens
RAGARAARSRRPRRHLFPPPSVCLLLALSVCSAAPRLPATGSARPGAPSARRGPVPERPGPAGLGCGPGSIVRRSVCPEAGPRDPERSAAPRRRIQITWIQSSLLCSVGTAPELEVSILQGGSNISSRETGKDQSSCIRETCPVGNRQIQIKFTVTGNLNSDPLLELCQCPLCQLDCGSREQLIAHVYQHTAAVVSAKSYMCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAFEEQNSSSLH

SEQ ID NO: 799069 - protein, 219 aa, Homo sapiens
MESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAFEEQNSSSLLNPPLGGLFHN

SEQ ID NO: 799070 - protein, 514 aa, Homo sapiens
MKEAGQMQNLESARAGRSVSTQTGSMTGQIPRLSKVNLFTLLSLWMELFPAEAQRQKSQKNEEGKHGPLGDNEERTRVSTDKRQVKRTGLVVVKNMKIVGLHCSSEDLHAGQIALIKHGSRLKNCDLYFSRKPCSACLKMIVNAGVNRISYWPADPEISLLTEASSSEDAKLDAKAVERLKSNSRAHVCVLLQPLVCYMVQFVEETSYKCDFIQKITKTLPDANTDFYYECKQERIKEYEMLFLVSNEEMHKQILMTIGLENLCENPYFSNLRQNMKDLILLLATVASSVPNFKHFGFYRSNPEQINEIHNQSLPQEIARHCMVQARLLAYRTEDHKTGVGAVIWAEGKSRSCDGTGAMYFVGCGYNAFPVGSEYADFPHMDDKQKDREIRKFRYIIHAEQNALTFRCQEIKPEERSMIFVTKCPCDECVPLIKGAGIKQIYAGDVDVGKKKADISYMRFGELEGVSKFTWQLNPSGAYGLEQNEPERRENGVLRPVPQKEEQHQDKKLRLGIH

SEQ ID NO: 799071 - protein, 469 aa, Homo sapiens
MELFPAEAQRQKSQKNEEGKHGPLGDNEERTRVSTDKRQVKRTGLVVVKNMKIVGLHCSSEDLHAGQIALIKHGSRLKNCDLYFSRKPCSACLKMIVNAGVNRISYWPADPEISLLTEASSSEDAKLDAKAVERLKSNSRAHVCVLLQPLVCYMVQFVEETSYKCDFIQKITKTLPDANTDFYYECKQERIKEYEMLFLVSNEEMHKQILMTIGLENLCENPYFSNLRQNMKDLILLLATVASSVPNFKHFGFYRSNPEQINEIHNQSLPQEIARHCMVQARLLAYRTEDHKTGVGAVIWAEGKSRSCDGTGAMYFVGCGYNAFPVGSEYADFPHMDDKQKDREIRKFRYIIHAEQNALTFRCQEIKPEERSMIFVTKCPCDECVPLIKGAGIKQIYAGDVDVGKKKADISYMRFGELEGVSKFTWQLNPSGAYGLEQNEPERRENGVLRPVPQKEEQHQDKKLRLGIH

SEQ ID NO: 799072 - protein, 316 aa, Homo sapiens
MVQFVEETSYKCDFIQKITKTLPDANTDFYYECKQERIKEYEMLFLVSNEEMHKQILMTIGLENLCENPYFSNLRQNMKDLILLLATVASSVPNFKHFGFYRSNPEQINEIHNQSLPQEIARHCMVQARLLAYRTEDHKTGVGAVIWAEGKSRSCDGTGAMYFVGCGYNAFPVGSEYADFPHMDDKQKDREIRKFRYIIHAEQNALTFRCQEIKPEERSMIFVTKCPCDECVPLIKGAGIKQIYAGDVDVGKKKADISYMRFGELEGVSKFTWQLNPSGAYGLEQNEPERRENGVLRPVPQKEEQHQDKKLRLGIH

SEQ ID NO: 799073 - protein, 316 aa, Homo sapiens; identical to SEQ ID NO: 799072

SEQ ID NO: 799074 - protein, 316 aa, Homo sapiens; identical to SEQ ID NO: 799072

SEQ ID NO: 799075 - protein, 396 aa, Homo sapiens
MKRGPEYLLTKDRKPCSACLKMIVNAGVNRISYWPADPEISLLTEASSSEDAKLDAKAVERLKSNSRAHVCVLLQPLVCYMVQFVEETSYKCDFIQKITKTLPDANTDFYYECKQERIKEYEMLFLVSNEEMHKQILMTIGLENLCENPYFSNLRQNMKDLILLLATVASSVPNFKHFGFYRSNPEQINEIHNQSLPQEIARHCMVQARLLAYRTEDHKTGVGAVIWAEGKSRSCDGTGAMYFVGCGYNAFPVGSEYADFPHMDDKQKDREIRKFRYIIHAEQNALTFRCQEIKPEERSMIFVTKCPCDECVPLIKGAGIKQIYAGDVDVGKKKADISYMRFGELEGVSKFTWQLNPSGAYGLEQNEPERRENGVLRPVPQKEEQHQDKKLRLGIH

SEQ ID NO: 799076 - protein, 514 aa, Homo sapiens; identical to SEQ ID NO: 799070

SEQ ID NO: 799077 - protein, 316 aa, Homo sapiens; identical to SEQ ID NO: 799072

SEQ ID NO: 799078 - protein, 514 aa, Homo sapiens; identical to SEQ ID NO: 799070

SEQ ID NO: 799079 - protein, 514 aa, Homo sapiens; identical to SEQ ID NO: 799070

SEQ ID NO: 799080 - protein, 110 aa, Homo sapiens
MRTRSGHSRFLHRLPPLATGVGDVGAAAVHGAQPTAAATPRALAAGSPEPGVGWDHCGGRRRVPRSRARSTCVLSGQWRGRRASTPRRHAGFRSPRQYSVVNHLSWDNQN

SEQ ID NO: 799081 - protein, 87 aa, Homo sapiens
KTTEGASFLPPCEEDKNKNEVTSPQGSVKATHKISSYLLVDDVWRHIASVTGHTSDGFTATPGGHEGVFQGHISNLTERTGSDQYPN

SEQ ID NO: 799082 - protein, 111 aa, Homo sapiens
LPFLETDSAVQKELRNQTPAPSAAQTSAPSKYHRTRSGGARDERYRSDIHTEAVQAALAKHKEQKMALPMPTKRRSTFVQSPADACTPPDTSSASEDEGSLRRQAALSAAL

SEQ ID NO: 799083 - protein, 99 aa, Homo sapiens
GSRWRVLVCGRGWSRCFSVTGAWPGQSCRRHPPATASVDGRVLGRRVLAGTTERGGVRSLESSVPGNSPLTTPCPALGPARGPNHWKAVAGNGRLCRRS

SEQ ID NO: 799084 - protein, 129 aa, Homo sapiens
MSHLQSLLLDTLLGTKHVDSAALIKIQERSLCVASPGFNVTPSDVRTLVNGFAKNPLQARREGLYFKGKDYRCVRADEYSLYAKNENTGVVVVKTHLYLLVATYTEGMYPSICVEATESLGDYLRKKGS

SEQ ID NO: 799085 - protein, 86 aa, Homo sapiens
GRPGRASPRGPREREERRARVAEAGAAGTRSAGLLRAGASSRSTAPGVTCWSLPAREENVAALRDAPDPGLGAVAGSPGEQQRREF

SEQ ID NO: 799086 - protein, 216 aa, Homo sapiens
MWPPCGTLRTLALARSRGARACSGDGGVSYTQGQSPEPRTREYFYYVDHQGQLFLDDSKMKNFITCFKDPQFLVTFFSRLRPNRSGRYEAAFPFLSPCGRERNFLRCEDRPVVFTHLLTADHGPPRLSYCGGGEALAVPFEPARLLPLAANGRLYHPAPERAGGVGLVRSALAFELSACFEYGPGAPALPSHVRWQGRRLALTMDLAPLLLAARSP

SEQ ID NO: 799087 - protein, 295 aa, Homo sapiens
MWPPCGTLRTLALARSRGARACSGDGGVSYTQGQSPEPRTREYFYYVDHQGQLFLDDSKMKNFITCFKGNAVPALSSPFFLPSGQPLMGSPTLPTGPAHQGVGVLRSGAPLSEAGRTSYRRRLPSVWSWARRPWEPSALSTRTLHPPDPQFLVTFFSRLRPNRSGRYEAAFPFLSPCGRERNFLRCEDRPVVFTHLLTADHGPPRLSYCGGGEALAVPFEPARLLPLAANGRLYHPAPERAGGVGLVRSALAFELSACFEYGPGAPALPSHVRWQGRRLALTMDLAPLLLAARSP

SEQ ID NO: 799088 - protein, 199 aa, Homo sapiens
MWPPCGTLRTLALARSRGARACSGDGGVSYTQGQSPEPRTREYFYYVDHQGQLFLDDSKMKNFITCFKDPQFLVTFFSRLRPNRSGRYEAAFPFLSPCGRERNFLRCEDRPVVFTHLLTADHGPPRLSYCGGGEALAVPFEPARLLPLAANGRLYHPAPERAGGVGLVRSALAFELRSSSAVSSEAKNLLHLRSLPGGG

SEQ ID NO: 799089 - protein, 216 aa, Homo sapiens; identical to SEQ ID NO: 799086

SEQ ID NO: 799090 - protein, 216 aa, Homo sapiens; identical to SEQ ID NO: 799086

SEQ ID NO: 799091 - protein, 216 aa, Homo sapiens; identical to SEQ ID NO: 799086

SEQ ID NO: 799092 - protein, 260 aa, Homo sapiens
GELGRSGPRLLHGPRPCCVVQLRTLSYKSPAPALTSRRCQGDTRAALPFFGSPVKRQLHVREAAGQVVSAEEVVQLITNLKRGKRCGKELADQGAELFLDDSKMKNFITCFKDPQFLVTFFSRLRPNRSGRYEAAFPFLSPCGRERNFLRCEDRPVVFTHLLTADHGPPRLSYCGGGEALAVPFEPARLLPLAANGRLYHPAPERAGGVGLVRSALAFELSACFEYGPGAPALPSHVRWQGRRLALTMDLAPLLLAARSP

SEQ ID NO: 799093 - protein, 610 aa, Homo sapiens
MWPPCGTLRTLALARSRGARACSGDGGVSYTQGQSPEPRTREYFYYVDHQGQLFLDDSKMKNFITCFKDPQFLVTFFSRLRPNRSGRYEAAFPFLSPCGRERNFLRCEDRPVVFTHLLTADHGPPRLSYCGGGEALAVPFEPARLLPLAANGRLYHPAPERAGGVGLVRSALAFELSACFEYGPGAPALPSHVRWQGRRLALTMDLAPLLLAARSPERGQGKGGRPRAPLAPLPRDSTPRKARATRARGSLVRLRARPRPHPALSLVLPRPGPPGHPGSATARAPRAPDSGALRDWPALETSGTGGGRGALVRVRERPPPPPSPATARARPPPARRGSRSPRERQEGTRLRLNRGRAGGGTGPREMALRAPALLPLLLLLLPLRAAGCPAACRCYSATVECGALRLRVVPLGIPPGTQTLFLQDNNIARLEPGALAPLAALRRLYLHNNSLRALEAGAFRAQPRLLELALTSNRLRGLRSGAFVGLAQLRVLYLAGNQLARLLDFTFLHLPRLQELHLQENSIELLEDQALAGLSSLALLDLSRNQLGTISREALQPLASLQVLRLTENPWRCDCALHWLGAWIKEGGQRLLTSRDRKIMCAEPPRLALQ

SEQ ID NO: 799094 - protein, 893 aa, Homo sapiens
GWCRWRRRGSAGQEASGKMDPAPSLGCSLKDVKWSSVAVPLDLLVSTYRLPQIARLDNGECVEGLRENDYLLIHSCRQWTTITAHSLEEGHYVIGPKIEIPVHYAGQFKLLEQDRDIKEPVQYFNSVEEVAKAFPERVYVMEDITFNVKVASGECNEDTEVYNITLCTGDELTLMGQAEILYAKTFKEKSRLNTIFKKIGKLNSISKLGKGKMPCLICMNHRTNESISLPFQCKGRFSTRSPLELQMQEGEHTIRNIVEKTRLPVNVTVPSPPPRNPYDLHFIREGHRYKFVNIQTKTVVVCCVLRNNKILPMHFPLHLTVPKFSLPEHLVKGESWPETLVHHWLGICQEQFDIDEYSRAVRDVKTDWNEECKSPKKGRCSGHNHVPNSLSYARDELTQSFHRLSVCVYGNNLHGNSEVNLHGCRDLGGDWAPFPHDILPYQDSGDSGSDYLFPEASEESAGIPGKSELPYEELWLEEGKPSHQPLTRSLSEKNRCDQFRGSVRSKCATSPLPIPGTLGAAVKSSDTALPPPPVPPKSEAVREECRLLNAPPVPPRSAKPLSTSPSIPPRTVKPARQQTRSPSPTLSYYSSGLHNIVTKTDTNPSESTPVSCYPCNRVKTDSVDLKSPFGSPSAEAVSSRLSWPNHYSGASESQTRSDFLLDPSRSYSYPRQKTPGTPKRNCPAPFDFDGCELLASPTSPVTAEFSSSVSGCPKSASYSLESTDVKSLAAGVTKQSTSCPALPPRAPKLVEEKVASETSPLPLKIDGAEEDPKSGSPDLSEDQYFVKKGMQDIFSASYPFSSPLHLQLAPRSCGDGSPWQPPADLSGLSIEEVSKSLRFIGLSEDVISFFVTEKIDGNLLVQLTEEILSEDFKLSKLQVKKIMQFINGWRPKI

SEQ ID NO: 799095 - protein, 893 aa, Homo sapiens; identical to SEQ ID NO: 799094

SEQ ID NO: 799096 - protein, 753 aa, Homo sapiens
MEDITFNVKVASGECNEDTEVYNITLCTGDELTLMGQAEILYAKTFKEKSRLNTIFKKIGKLNSISKLGKGKMPCLICMNHRTNESISLPFQCKGRFSTRSPLELQMQEGEHTIRNIVEKTRLPVNVTVPSPPPRNPYDLHFIREGHRYKFVNIQTKTVVVCCVLRNNKILPMHFPLHLTVPKFSLPEHLVKGESWPETLVHHWLGICQEQFDIDEYSRAVRDVKTDWNEECKSPKKGRCSGHNHVPNSLSYARDELTQSFHRLSVCVYGNNLHGNSEVNLHGCRDLGGDWAPFPHDILPYQDSGDSGSDYLFPEASEESAGIPGKSELPYEELWLEEGKPSHQPLTRSLSEKNRCDQFRGSVRSKCATSPLPIPGTLGAAVKSSDTALPPPPVPPKSEAVREECRLLNAPPVPPRSAKPLSTSPSIPPRTVKPARQQTRSPSPTLSYYSSGLHNIVTKTDTNPSESTPVSCYPCNRVKTDSVDLKSPFGSPSAEAVSSRLSWPNHYSGASESQTRSDFLLDPSRSYSYPRQKTPGTPKRNCPAPFDFDGCELLASPTSPVTAEFSSSVSGCPKSASYSLESTDVKSLAAGVTKQSTSCPALPPRAPKLVEEKVASETSPLPLKIDGAEEDPKSGSPDLSEDQYFVKKGMQDIFSASYPFSSPLHLQLAPRSCGDGSPWQPPADLSGLSIEEVSKSLRFIGLSEDVISFFVTEKIDGNLLVQLTEEILSEDFKLSKLQVKKIMQFINGWRPKI

SEQ ID NO: 799097 - protein, 554 aa, Homo sapiens
GWCRWRRRGSAGQEASGKMDPAPSLGCSLKDVKWSSVAVPLDLLVSTYRLPQIARLDNGECVEGLRENDYLLIHSCRQWTTITAHSLEEGHYVIGPKIEIPVHYAGQFKLLEQDRDIKEPVQYFNSVEEVAKAFPERVYVMEDITFNVKVASGECNEDTEVYNITLCTGDELTLMGQAEILYAKTFKEKSRLNTIFKKIGKLNSISKLGKGKMPCLICMNHRTNESISLPFQCKGRFSTRSPLELQMQEGEHTIRNIVEKTRLPVNVTVPSPPPRNPYDLHFIREGHRYKFVNIQTKTVVVCCVLRNNKILPMHFPLHLTVPKFSLPEHLVKGESWPETLVHHWLGICQEQFDIDEYSRAVRDVKTDWNEECKSPKKGRCSGHNHVPNSLSYARDELTQSFHRLSVCVYGNNLHGNSEVNLHGCRDLGGDWAPFPHDILPYQDSGDSGSDYLFPEASEESAGIPGKSELPYEELWLEEGKPSHQPLTRSLSEKNRCDQFRGSVRSKCATSPLPIPGTLGAAVKSSDTALPPPPVPPKSEARQGFITLPRLVSKS

SEQ ID NO: 799098 - protein, 698 aa, Homo sapiens
GWCRWRRRGSAGQEASGKMDPAPSLGCSLKDVKWSSVAVPLDLLVSTYRLPQIARLDNGECVEGLRENDYLLIHSCRQWTTITAHSLEEGHYVIGPKIEIPVHYAGQFKLLEQDRDIKEPVQYFNSVEEVAKAFPERVYVMEDITFNVKVASGECNEDTEVYNITLCTGDELTLMGQAEILYAKTFKEKSRLNTIFKKIGKLNSISKLGKGKMPCLICMNHRTNESISLPFQCKGRFSTRSPLELQMQEGEHTIRNIVEKTRLPVNVTVPSPPPRNPYDLHFIREGHRYKFVNIQTKTVVVCCVLRNNKILPMHFPLHLTVPKFSLPEHLVKGESWPETLVHHWLGICQEQFDIDEYSRAVRDVKTDWNEECKSPKKGRCSGHNHVPNSLSYARDELTQSFHRLSVCVYGNNLHGNSEVNLHGCRDLGGDWAPFPHDILPYQDSGDSGSDYLFPEASEESAGIPGKSELPYEELWLEEGKPSHQPLTRSLSEKNRCDQFRGSVRSKCATSPLPIPGTLGAAVKSSDTALPPPPVPPKSEAVREECRLLNAPPVPPRSAKPLSTSPSIPPRTVKPARQQTRSPSPTLSYYSSGLHNIMEEPMSWEEKMPHQSEKFRGKGQLDSPGNNPGAAISSHKSASGSFHFDTSRQHLQADNTFDQDLKWKGSHWLSTLNFHPDRSPLLTITVEWSFPFVWILPGL

SEQ ID NO: 799099 - protein, 415 aa, Homo sapiens
ARGGGDPYSDLSKGVLRCRTVEDVLTPLEDCFMLDASTVLDFGVLASIMESGYTRIPVFEDEQSNIVDILYVKDLAFVDPDDCTPLKTITRFYNHPVHFVFHDTKLDAMLEEFKKGKSHLAIVQKVNNEGEGDPFYEVLGLVTLEDVIEEIIKSEILDESDMYTEDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 799100 - protein, 392 aa, Homo sapiens
MPEAVHIGDLLRLLKYPDVIQELKFDEHYKYYARHYLYTRNKPADYFILILQGKVEVEAGKENMKFETGAFSYYGTMALTSVPSGKSHLAIVQKVNNEGEGDPFYEVLGLVTLEDVIEEIIKSEILDESDMYTDNRSRKRVSEKNKRDFSAFKDADNELKVKISPQLLLAAHRFLATEVSQFSPSLISEKILLRLLKYPDVIQELKFDEHNKYYARHYLYTRNKPADYFILILQGKVEVEAGKENMKFETGAFSYYGTMALTSVPSDRSPAHPTPLSRSASLSYPDRTDVSTAATLAGSSNQFGSSVLGQYISDFSVRALVDLQYIKITRQQYQNGLLASRMENSPQFPIDGCTTHMENLAEKSELPVVDETTTLLNERNSLLHKASHENAI

SEQ ID NO: 799101 - protein, 727 aa, Homo sapiens
MRLASCNKSCGTNPDGIIFVSEGSTVNLRLYGYSLGNISSNLISFTEVDDAETLHKSTSCLELTKDLVVQQLVNVSRGNTSGVLVVLTKFLRRSESMKLYALCTRAQPDGPWLKWTDKDSLLFMVEEPGRFLPLWLHILLITVLLVLSGIFSGLNLGLMALDPMELRIVQNCGTEKERRYARKIEPIRRKGNYLLCSLLLGNVLVNTSLTILLDNLIGSGLMAVASSTIGIVIFGEILPQALCSRHGLAVGANTILLTKFFMLLTFPLSFPISKLLDFFLGQEIRTVYNREKLMEMLKVTEPYNDLVKEELNMIQGALELRTKTVEDIMTQLQDCFMIRSDAILDFNTMSEIMESGYTRIPVFEDEQSNIVDILYVKDLAFVDPDDCTPLKTITRFYNHPVHFVFHDTKLDAMLEEFKKGKSHLAIVQKVNNEGEGDPFYEVLGLVTLEDVIEEIIKSEILDESDMYTDNRSRKRVSEKNKRDFSAFKDADNELKVKISPQLLLAAHRFLATEVSQFSPSLISEKILLRLLKYPDVIQELKFDEHNKYYARHYLYTRNKPADYFILILQGKVEVEAGKENMKFETGAFSYYGTMALTSVPSDRSPAHPTPLSRSASLSYPDRTDVSTAATLAGSSNQFGSSVLGQYISDFSVRALVDLQYIKITRQQYQNGLLASRMENSPQFPIDGCTTHMENLAEKSELPVVDETTTLLNERNSLLHKASHENAI

SEQ ID NO: 799102 - protein, 727 aa, Homo sapiens; identical to SEQ ID NO: 799101

SEQ ID NO: 799103 - protein, 126 aa, Homo sapiens
MRVRVGIGVAFGMTTSALPADRSPAHPTPLSRSASLSYPDRTDVSTAATLAGSSNQFGSSVLGQYISDFSVRALVDLQYIKVSASLPCLGSAIFCSGISYYFHPPNPAWWAQTRDAFFFWRWGLAL

SEQ ID NO: 799104 - protein, 339 aa, Homo sapiens
LQEPAERAPRGAPQPLQGIWWRLGWPRPPGSTGPSSPRGGSPLDAGPRARTPTGPGPRAPGKPASRSPGPRRAGALRGAHRPQTCVAVQGVAMSSVFGKPRAGSGPQSAPLEVNLAILGRRGAGKSEDTYSSEETVDHQPVHLRVMDTADLDTPRNCERYLNWAHAFLVVYSVDSRQSFDSSSSYLELLALHAKETQRSIPALLLGNKLDMAQYRQVTKAEGVALAGRFGCLFFEVSACLDFEHVQHVFHEAVREARRELEKSPLTRPLFISEERALPHQAPLTARHGLASCTFNTLSTINLKEMPTVAQAKLVTVKSSRAQSKRKAPTLTLLKGFKIF

SEQ ID NO: 799105 - protein, 358 aa, Homo sapiens
LQEPAERAPRGAPQPLQGIWWRLGWPRPPGSTGPSSPRGGSPLDAGPRARTPTGPGPRAPGKPASRSPGPRRAGALRGAHRPQTCVAVQGVAMSSVFGKPRAGSGPQSAPLEVNLAILGRRGAGKSALTVKFLTKRFISEYDPNLEDTYSSEETVDHQPVHLRVMDTADLDTPRNCERYLNWAHAFLVVYSVDSRQSFDSSSSYLELLALHAKETQRSIPALLLGNKLDMAQYRQVTKAEGVALAGRFGCLFFEVSACLDFEHVQHVFHEAVREARRELEKSPLTRPLFISEERALPHQAPLTARHGLASCTFNTLSTINLKEMPTVAQAKLVTVKSSRAQSKRKAPTLTLLKGFKIF

SEQ ID NO: 799106 - protein, 358 aa, Homo sapiens; identical to SEQ ID NO: 799105

SEQ ID NO: 799107 - protein, 167 aa, Homo sapiens [sequence omitted]

SEQ ID NO: 799108 - protein, 101 aa, Homo sapiens
SPQGSEVDPGGARSRLSASCVLSRVETGVDPGAPVPRHRLLQFLQTVPIPPRVARRDLEFAMLRAVSTWRFRLDPSCSGARLGGPRSLSFLASLGCGTKTI

SEQ ID NO: 799109 - protein, 102 aa, Homo sapiens
TFFLLYKCFISIQYLEDSYKQDAFNSMVADEHQEGTSMSFHPRNLTMDTLVIKGLVSPQDTVTDQRPHHPSSGAGPAGTGSFCDTCCITRLGERTQLPELTE

SEQ ID NO: 799110 - protein, 102 aa, Homo sapiens; identical to SEQ ID NO: 799109

SEQ ID NO: 799111 - protein, 177 aa, Homo sapiens
ERLCLPERGTRRPGGGGRSDAAMAPRALPGSAVLAAAVFVGGAVSSPLVAPDNGSSRTLHSRTETTPSPSNDTGNGHPEYIAYALVPVFFIMGLFGVLICHLLKKKGYRCTTEAEQDIEEEKVEKIELNDSVNENSDTVGQIVHYIMKNEGVNILVFQNNSVFLSFIKNLLRRVKIY

SEQ ID NO: 799112 - protein, 180 aa, Homo sapiens
ERLCLPERGTRRPGGGGRSDAAMAPRALPGSAVLAAAVFVGGAVSSPLVAPDNGSSRTLHSRTETTPSPSNDTGNGHPEYIAYALVPVFFIMGLFGVLICHLLKKKGYRCTTEAEQDIEEEKVEKIELNDSVNENSDTVGQIVHYIMKNEANADVLKAMVADNSLYDPESHRARPVNECL

SEQ ID NO: 799113 - protein, 293 aa, Homo sapiens
ERLCLPERGTRRPGGGGRSDAAMAPRALPGSAVLAAAVFVGGAVSSPLVAPDNGSSRTLHSRTETTPSPSNDTGNGHPEYIAYALVPVFFIMGLFGVLICHLLKKKGYRCTTEAEQDIEEEKVEKIELNDSVNENSDTVGQIVHYIMKNEANADVLKAMVADNSLYDPESPVTPSTPGSPPVSPGPLSPGGTPGKHVCGHHLHTVGGVVERDVCHRCRHKRWHFIKPTNKSRESRPRRQGEVTVLSVGRFRVTKVEHKSNQKERRSLMSVSGAETVNGEVPATPVKRERSGTE

SEQ ID NO: 799114 - protein, 69 aa, Homo sapiens
MFMPLYSTLGDREPVSNKPTKNCRATGFVTSFVELFDFSKQCAWIILIKTKTVFERDRTLTNILFLLFE

SEQ ID NO: 799115 - protein, 271 aa, Homo sapiens
MWELRSIAFSRAVFAEFLATLLFVFFGLGSALNWPQALPSVLQIAMAFGLGIGTLVQALGHISGAHINPAVTVACLVGCHVSVLRAAFYVAAQLLGAVAGAALLHEITPADIRGDLAVNALSNSTTAGQAVTVELFLTLQLVLCIFASTDERRGENPGTPALSIGFSVALGHLLGIHYTGCSMNPARSLAPAVVTGKFDDHWVFWIGPLVGAILGSLLYNYVLFPPAKSLSERLAVLKGLEPDTDWEEREVRRRQSVELHSPQSLPRGTKA

SEQ ID NO: 799116 - protein, 624 aa, Homo sapiens
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRPDFELGKMIKQSYKNVLEKFRLKKAQKDEDKKTKGSGDLAEQARREGFDENEIQNAEQMKKWKERLEKKYYSMEIQDDYQPVTQEEFRELFLYAVELEKELHYINLKLNQVVRKVSAL

SEQ ID NO: 799117 - protein, 564 aa, Homo sapiens
MSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRPDFELGKMIKQSYKNVLEKFRLKKAQKDEDKKTKGSGDLAEQARREGFDENEIQNAEQMKKWKERLEKKYYSMEIQDDYQPVTQEEFRELFLYAVELEKELHYINLKLNQVVRKVSAL

SEQ ID NO: 799118 - protein, 609 aa, Homo sapiens
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRPDFELGKMIKQSYKNVLEKFRLKKAQKDEDKKTKGSGDLAEQARREGFDENEIQNAEQMKKWKERLEKKYYSMEIQDDYQPVTQEEFRDGTTTKYKMRFSLSA

SEQ ID NO: 799119 - protein, 624 aa, Homo sapiens; identical to SEQ ID NO: 799116

SEQ ID NO: 799120 - protein, 57 aa, Homo sapiens
MRGFTCFVFCFFILRLARRHHDIKSVSGRAQWLKPVIPTLWEAEAGGSQGQEIETIL

SEQ ID NO: 799121 - protein, 310 aa, Homo sapiens
MRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPHSLGDYASLFAEGSRARGGDPCVGFHQVGARGCRRAGGRLFAQTFGA

SEQ ID NO: 799122 - protein, 161 aa, Homo sapiens
RQFSLRPVTPTQRETHRPDSPCVNASQSTWGRQVSRWAMPAGSSIAWNMGFSLMGRCPVTRPLVEGTTPSPPSSVKLVLENTYPGQFLWIWSLRSLIAEAWARLDHKFDLMYAKRAFVHWYVGEGMEEGEFSEAREDMAALEKDYEEVGIDSYEDEDEGEE

SEQ ID NO: 799123 - protein, 91 aa, Homo sapiens
PLFIGTSLLIGTSLFIGTHTTLEHSDCAFMVDNEAIYDICRRNLDIERPTYTNLNRLISQIVSSITASLRFDGALNVDLTEFQTNLVPYPR

SEQ ID NO: 799124 - protein, 448 aa, Homo sapiens
MRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 799125 - protein, 361 aa, Homo sapiens
MRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWSDKRVPMNGILKNSQ

SEQ ID NO: 799126 - protein, 448 aa, Homo sapiens; identical to SEQ ID NO: 799124

SEQ ID NO: 799127 - protein, 448 aa, Homo sapiens; identical to SEQ ID NO: 799124

SEQ ID NO: 799128 - protein, 310 aa, Homo sapiens; identical to SEQ ID NO: 799121

SEQ ID NO: 799129 - protein, 433 aa, Homo sapiens
MGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 799130 - protein, 537 aa, Homo sapiens
HSRPESPGRQGWKGRGEGQLWPYGKDRLACSRPKSEHLDDRCLQDAGAGETRPATAPCISAEALGSPACLLKTRKEWLKPESRLLIPAGQRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 799131 - protein, 454 aa, Homo sapiens
SPLSIPQRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 799132 - protein, 475 aa, Homo sapiens
LGCRMAPILPGTRRVTSGASPQVPLPFWRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 799133 - protein, 448 aa, Homo sapiens; identical to SEQ ID NO: 799124

SEQ ID NO: 799134 - protein, 460 aa, Homo sapiens
SFRNLTLLTTTANRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 799135 - protein, 394 aa, Homo sapiens
AGCESAEGTRLNVRRTARTHHDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 799136 - protein, 374 aa, Homo sapiens
PVPIRSGVDRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 799137 - protein, 529 aa, Homo sapiens
MRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLVRVCLGREGTFETVLMVRNIFFQTPFRRSSLTIHGLECGAAMASSVFALTADVSYSFMEPGDRVPQAPPLPKLFFLVLAFQSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 799138 - protein, 353 aa, Homo sapiens
GSNYTVLRLSCISDIGSTRIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 799139 - protein, 627 aa, Homo sapiens
MRECISVHVGQAGVQMGNACWELYCLEHGIQPDGQMPSDKTIGGGDDSFTTFFCETGAGKHVPRAVFVDLEPTVIGEEEVGTKLKGVEHDSKLLPGERGYLDQAFLALKIPSRTSSCRRQADLRLAWAAGLGFSHTLVSQAGRRMSPSMHLATATTLGEEVPAEHSFVVFALPDEIRNGPYRQLFHPEQLITGKEDAANNYARGHYTIGKEIIDPVLDRIRKLVRVCLGREGTFETVLMVRNIFFQTPFRRSSLTIHGLECGAAMASSVFALTADVSYSFMEPGDRVPQAPPLPKLFFLVLAFQSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLATYAPVISAEKAYHEQLSVAEITNACFEPANQMVKCDPRHGKYMACCLLYRGDVVPKDVNAAIAAIKTKRSIQFVDWCPTGFKVGINYQPPTVVPGGDLAKVQRAVCMLSNTTAIAEAWARLDHKFDLMYAKRAFVHWYVGEGMEEGEFSEAREDMAALEKDYEEVGIDSYEDEDEGEE

SEQ ID NO: 799140 - protein, 299 aa, Homo sapiens
MRECISVHVGQAGVQMGNACWELYCLEHGIQPDGQMPSDKTIGGGDDSFTTFFCETGAGKHVPRAVFVDLEPTVIDEIRNGPYRQLFHPEQLITGKEDAANNYARGHYTIGKEIIDPVLDRIRKLSDQCTGLQGFLVFHSFGGGTGSGFTSLLMERLSVDYGKKSKLEFSIYPAPQVSTAVVEPYNSILTTHTTLEHSDCAFMVDNEAIYDICRRNLDIERPTYTNLNRLISQIVSSITASLRFDGALNVDLTEFQTNLVPYPHSRGPMQFLEGPRAAGGPRLWPPVLCPGIASNVRNP

SEQ ID NO: 799141 - protein, 448 aa, Homo sapiens; identical to SEQ ID NO: 799124

SEQ ID NO: 799142 - protein, 448 aa, Homo sapiens; identical to SEQ ID NO: 799124

SEQ ID NO: 799143 - protein, 135 aa, Homo sapiens
SPPSPRLNSVGSRALDTVLTPGHPPPSWPRWSLALASAERSGAPAAPTPSSVPPRAAAPATWPRRWLGRGDSRAPPQPAAPTRAPPHRWPSPRPTRASQAQPHLLPREDSDPPKAGGGGGGGRGGRSWRSRGLAR

SEQ ID NO: 799144 - protein, 239 aa, Homo sapiens
NTSCSPRRHPRAAAPPALPPSTRGSPSQLGGPPPFCPARSGRRRPPRLAPSSRVPGPAVGAGRARRGRGPRLVPQRMSCRGRGAGGRWNSTSWSTGCKLPASPRRVSRCSPTGLIKLAFLFSKTRCKFFSLTETPEDYTIIVDEEGFLELPSSEHLSVADATWLALNVVSGGGSFSSSQPIGMTKIAKSVIAPLADQNISVFMLSTYQTDFILVLKRDLPFVTHTLSSEFTILWSVARL

SEQ ID NO: 799145 - protein, 227 aa, Homo sapiens
NTSCSPRRHPRAAAPPALPPSTRGSPSQLGGPPPFCPARSGRRRPPRLAPSSRVPGPAVGAGRARRGRGPRLVPQRMSCRGRGAGGRWNSTSWSTGCKLPASPRRVSRCSPTGLIKLAFLFSKTRCKFFSLTETPEDYTIIVDEEGFLELPSSEHLSVADATWLALNVVSGGGSFSSSQPIGMTKIAKSVIAPLADQNISVFMLSTYQTDFILQSAGITGLSHRTQP

SEQ ID NO: 799146 - protein, 71 aa, Homo sapiens
MTRTPYPAPFALNTALISDREEKTHRTSRVGFTGHPERMGGSFQAGKRKRDGVKRNGWRQGAWHRGRDRGG

SEQ ID NO: 799147 - protein, 698 aa, Homo sapiens
MPSEGRCWETLKALRSSDKGRLCYYRDWLLRREDVLEECMSLPKLSSYSGWVVEHVLPHMQENQPLSETSPSSTSASALDQPSFVPKSPDASSAFSPASPATPNGTKGKDESQHTESMVLQSSRGIKVEGCVRMYELVHRMKGTEGLRLWQEEQERKVQALSEMASEQLKRFDEWKELKQHKEFQDLREVMEKSSREALGHQEKLKAEHRHRAKILNLKLREAEQQRVKQAEQERLRKEEGQIRLRALYALQEEMLQLSQQLDASEQHKALLKVDLAAFQTRGNQLCSLISGIIRASSESSYPTAESQAEAERALREMRDLLMNLGQEITRACEDKRRQDEEEAQVKLQEAQMQQGPEAHKEPPAPSQGPGGKQNEDLQVKVQDITMQWYQQLQDASMQCVLTFEGLTNSKDSQAKKIKMDLQKAATIPVSQISTIAGSKLKEIFDKIHSLLSGKPVQSGGRSVSVTLNPQGLDFVQYKLAEKFVKQGEEEVASHHEAAFPIAVVASGIWELHPRVGDLILAHLHKKCPYSVPFYPTFKEGMALEDYQRMLGYQVKDSKVEQQDNFLKRMSGMIRLYAAIIQLRWPYGNRQEIHPHGLNHGWRWLAQILNMEPLSDVTATLLFDFLEVCGNALMKQYQVQFWKMLILIKEDYFPRIEAITSSGQMGSFIRLKQFLEKCLQHKDIPVPKGFLTSSFWRS

SEQ ID NO: 799148 - protein, 279 aa, Homo sapiens [sequence omitted]

SEQ ID NO: 799149 - protein, 659 aa, Homo sapiens
MPSEGRCWETLKALRSSDKGRLCYYRDWLLRREDVLEECMSLPKLSSYSGWVVEHVLPHMQENQPLSETSPSSTSASALDQPSFVPKSPDASSAFSPASPATPNGTKGKDESQHTESMVLQSSRGIKVEGCVRMYELVHRMKGTEGLRLWQEEQERKVQALSEMASEQLKRFDEWKELKQHKEFQDLREVMEKSSREALGHQEKLKAEHRHRAKILNLKLREAEQQRVKQAEQERLRKEEGQIRLRALYALQEEMLQLSQQLDASEQHKALLKVDLAAFQTRGNQLCSLISGIIRASSESSYPTAESQAEAERALREMRDLLMNLGQEITRACEDKRRQDEEEAQVKLQEAQMQQGPEAHKEPPAPSQGPGGKQNEDLQVKVQDITMQWYQQLQDASMQCVLTFEGLTNSKDSQAKKIKMDLQKAATIPVSQISTIAGSKLKEIFDKIHSLLSGKPVQSGGRSVSVTLNPQGLDFVQYKLAEKFVKQGEEEVASHHEAAFPIAVVASGIWELHPRVGDLILAHLHKKCPYSVPFYPTFKEGMALEDYQRMLGYQVKDSKVEQQDNFLKRMSGMIRLYAAIIQLRWPYGNRQEIHPHGLNHGWRWLAQILNMEPLSDVTATLLFDFLEVCGNALMKQYQVQFWKMLILIKEDYFPRYQAC

SEQ ID NO: 799150 - protein, 378 aa, Homo sapiens
MPSEGRCWETLKALRSSDKGRLCYYRDWLLRREDVLEECMSLPKLSSYSGWVVEHVLPHMQENQPLSETSPSSTSASALDQPSFVPKSPDASSAFSPASPATPNGTKGKDESQHTESMVLQSSRGIKVEGCVRMYELVHRMKGTEGLRLWQEEQERKVQALSEMASEQLKRFDEWKELKQHKEFQDLREVMEKSSREALGHQEKLKAEHRHRAKQRVKQAEQERLRKEEGQIRLRALYALQEEMLQLSQQLDASEQHKALLKVDLAAFQTRGNQLCSLISGIIRASSESSYPTAESQAEAERALREMRDLLMNLGQEITRACEDKRRQDEEEAQVKLQEAQMQQGPEAHKEPPAPSQGPGGKQNEDFQVNVQTSMRGT

SEQ ID NO: 799151 - protein, 135 aa, Homo sapiens [sequence omitted]

SEQ ID NO: 799152 - protein, 659 aa, Homo sapiens; identical to SEQ ID NO: 799149

SEQ ID NO: 799153 - protein, 701 aa, Homo sapiens
MPIIPTLCEAEAGRVLEASSSWEPGLVSHTCNPSTLDVLEECMSLPKLSSYSGWVVEHVLPHMQENQPLSETSPSSTSASALDQPSFVPKSPDASSAFSPASPATPNGTKGKDESQHTESMVLQSSRGIKVEGCVRMYELVHRMKGTEGLRLWQEEQERKVQALSEMASEQLKRFDEWKELKQHKEFQDLREVMEKSSREALGHQEKLKAEHRHRAKILNLKLREAEQQRVKQAEQERLRKEEGQIRLRALYALQEEMLQLSQQLDASEQHKALLKVDLAAFQTRGNQLCSLISGIIRASSESSYPTAESQAEAERALREMRDLLMNLGQEITRACEDKRRQDEEEAQVKLQEAQMQQGPEAHKEPPAPSQGPGGKQNEDLQVKVQDITMQWYQQLQDASMQCVLTFEGLTNSKDSQAKKIKMDLQKAATIPVSQISTIAGSKLKEIFDKIHSLLSGKPVQSGGRSVSVTLNPQGLDFVQYKLAEKFVKQGEEEVASHHEAAFPIAVVASGIWELHPRVGDLILAHLHKKCPYSVPFYPTFKEGMALEDYQRMLGYQVKDSKVEQQDNFLKRMSGMIRLYAAIIQLRWPYGNRQEIHPHGLNHGWRWLAQILNMEPLSDVTATLLFDFLEVCGNALMKQYQVQFWKMLILIKEDYFPRIEAITSSGQMGSFIRLKQFLEKCLQHKDIPVPKGFLTSSFWRS

SEQ ID NO: 799154 - protein, 698 aa, Homo sapiens; identical to SEQ ID NO: 799147

SEQ ID NO: 799155 - protein, 107 aa, Homo sapiens
MLISSMDSCSRSQNPARSWAVGRGLASGFCGPDGDQWGQLSRGLSCSPQPPNKQGSSGPCQHPRGLLRPSVWGRNRSSWPWCDSDTERSPIHSQVSAHRSPGQGCPP

SEQ ID NO: 799156 - protein, 1427 aa, Homo sapiens [sequence omitted]

SEQ ID NO: 799157 - protein, 1175 aa, Homo sapiens
MLLPSDVARLVLGYLQQENLISTCQTFILESSDLKEYAEHCTDEGFIPACLLSLFGKNLTTILNEYVAMKTKETSNNVPAIMSSLWKKLDHTLSQIRSMQSSPRFAGSQRARTRTGIAEIKRQRKLASQTAPASAELLTLPYLSGQFTTPPSTGTQVTRPSGQISDPSRSYFVVVNHSQSQDTVTTGEALNVIPGAQEKKAHASLMSPGRRKSESQRKSTTLSGPHSTIRNFQDPNAFAVEKQMVIENAREKILSNKSLQEKLAENINKFLTSDNNIAQVPKQTDNNPTEPETSIDEFLGLPSEIHMSEEAIQDILEQTESDPAFQALFDLFDYGKTKNNKNISQSISSQPMESNPSIVLADETNLAVKGSFETEESDGQSGQPAFCTSYQNDDPLNALKNSNNHDVLRQEDQENFSQISTSIQKKAFKTAVPTEQKCDIDITFESVPNLNDFNQRGNSNAECNPHCAELYTNQMSTETEMAIGIEKNSLSSNVPSESQLQPDQPDIPITSFVSLGCEANNENLILSGKSSQLLSQDTSLTGKPSKKSQFCENSNDTVKLKINFHGSKSSDSSEIHKSKIEINVLEPVMSQLSNCQDNSCLQSEILPVSVESSHLNVSGQVEIHLGDSLSSTKQPSNDSASVELNHTENEAQASKSENSQEPSSSVKEENTIFLSLGGNANCEKVALTPPEGTPVENSHSLPPESVCSSVGDSHPESQNTDDKPSSNNSAEIDASNIVSLKVIISDDPFVSSDTELTSAVSSINGENLPTIILSSPTKSPTKNAELVKCLSSEETVGAVVYAEVGDSASMEQSLLTFKSEDSAVNNTQNEDGIAFSANVTPCVSKDGGYIQLMPATSTAFGNSNNILIATCVTDPTALGTSVSQSNVVVLPGNSAPMTAQPLPPQLQTPPRSNSVFAVNQAVSPNFSQGSAIIIASPVQPVLQGMVGMIPVSVVGQNGNNFSTPPRQVLHMPLTAPVCNRSIPQFPVPPKSQKAQGLRNKPCIGKQVNNLVDSSGHSVGCHAQKTEVSDKSIATDLGKKSEETTVPFPEESIVPAAKPCHRRVLCFDSTTAPVANTQGPNHKMVSQNKERNAVSFPNLDSPNVSSTLKPPSNNAIKREKEKPPLPKILSKSESAISRHTTIRETQSEKKVSPTEIVLESFHKATANKENGDILSS

SEQ ID NO: 799158 - protein, 1277 aa, Homo sapiens
MIELGTESRPSGQISDPSRSYFVVVNHSQSQDTVTTGEALNVIPGAQEKKAHASLMSPGRRKSESQRKSTTLSGPHSTIRNFQDPNAFAVEKQMVIENAREKILSNKSLQEKLAENINKFLTSDNNIAQVPKQTDNNPTEPETSIDEFLGLPSEIHMSEEAIQDILEQTESDPAFQALFDLFDYGKTKNNKNISQSISSQPMESNPSIVLADETNLAVKGSFETEESDGQSGQPAFCTSYQNDDPLNALKNSNNHDVLRQEDQENFSQISTSIQKKAFKTAVPTEQKCDIDITFESVPNLNDFNQRGNSNAECNPHCAELYTNQMSTETEMAIGIEKNSLSSNVPSESQLQPDQPDIPITSFVSLGCEANNENLILSGKSSQLLSQDTSLTGKPSKKSQFCENSNDTVKLKINFHGSKSSDSSEIHKSKIEINVLEPVMSQLSNCQDNSCLQSEILPVSVESSHLNVSGQVEIHLGDSLSSTKQPSNDSASVELNHTENEAQASKSENSQEPSSSVKEENTIFLSLGGNANCEKVALTPPEGTPVENSHSLPPESVCSSVGDSHPESQNTDDKPSSNNSAEIDASNIVSLKVIISDDPFVSSDTELTSAVSSINGENLPTIILSSPTKSPTKNAELVKCLSSEETVGAVVYAEVGDSASMEQSLLTFKSEDSAVNNTQNEDGIAFSANVTPCVSKDGGYIQLMPATSTAFGNSNNILIATCVTDPTALGTSVSQSNVVVLPGNSAPMTAQPLPPQLQTPPRSNSVFAVNQAVSPNFSQGSAIIIASPVQPVLQGMVGMIPVSVVGQNGNNFSTPPRQVLHMPLTAPVCNRSIPQFPVPPKSQKAQGLRNKPCIGKQVNNLVDSSGHSVGCHAQKTEVSDKSIATDLGKKSEETTVPFPEESIVPAAKPCHRRVLCFDSTTAPVANTQGPNHKMVSQNKERNAVSFPNLDSPNVSSTLKPPSNNAIKREKEKPPLPKILSKSESAISRHTTIRETQSEKKVSPTEIVLESFHKATANKENELCSDVERQKNPENSKLSIGQQNGGLRSEKSIASLQEMTKKQGTSSNNKNVLSVGTAVKDLKQEQTKSASSLITTEMLQDIQRHSSVSRLADSSDLPVPRTPGSGAGEKHKEEPIDIIKAPSSRRFSEDSSTSKVMVPPVTPDLPACSPASETGSENSVNMAAHTLMILSRAAISRTTSATPLKDNTQQFRASSRSTTKKRKIEELDERERNSRPSSKNLTNSSIPMKKKKIKKKKLPSSFPAGMDVDKFLLSLHYDE

SEQ ID NO: 799159 - protein, 276 aa, Homo sapiens
FLSLGGNANCEKVALTPPEGTPVENSHSLPPESVCSSVGDSHPESQNTDDKPSSNNSAEIDASNIVSLKVIISDDPFVSSDTELTSAVSSINGENLPTIILSSPTKSPTKNAELVKCLSSEETVGAVVYAEVGDSASMEQSLLTFKSEDSAVNNTQNEDGIAFSANVTPCVSKDGGYIQLMPATSTAFGNSNNILIATCVTDPTALGTSVSQSNVVVLPGNSAPMTAQPLPPQLQTPPRSNSVFAVNQAVSPNFSQGNFNNIIEICFSGLGSNFFC

SEQ ID NO: 799160 - protein, 1427 aa, Homo sapiens [sequence omitted]

SEQ ID NO: 799161 - protein, 1427 aa, Homo sapiens [sequence omitted]

SEQ ID NO: 799162 - protein, 1427 aa, Homo sapiens [sequence omitted]

SEQ ID NO: 799163 - protein, 479 aa, Homo sapiens
MLLPSDVARLVLGYLQQENLISTCQTFILESSDLKEYAEHCTDEGFIPACLLSLFGKNLTTILNEYVAMKTKETSNNVPAIMSSLWKKLDHTLSQIRSMQSSPRFAGSQRARTRTGIAEIKRQRKLASQTAPASAELLTLPYLSGQFTTPPSTGTQVTRPSGQISDPSRSYFVVVNHSQSQDTVTTGEALNVIPGAQEKKAHASLMSPGRRKSESQRKSTTLSGPHSTIRNFQDPNAFAVEKQMVIENAREKILSNKSLQEKLAENINKFLTSDNNIAQVPKQTDNNPTEPETSIDEFLGLPSEIHMSEEAIQDILEQTESDPAFQALFDLFDYGKTKNNKNISQSISSQPMESNPSIVLADETNLAVKGSFETEESDGQSGQPAFCTSYQNDDPLNALKNSNNHDVLRQEDQENFSQISTSIQKKAFKTAVPTEQKCDIDITFESVPNLNDFNQRGNSNAECNPHCAEFFPPQFSLET

SEQ ID NO: 799164 - protein, 110 aa, Homo sapiens
QCALETFLAFHLLLICFTSCRCGVGSQVVASHGHGAFGPARLPGGAGRRLPHQTRGSRRRRLPGVAEPLLRLSSPLPHPGHSAVVSAGAGRADGDPWGSPPTAPLHRGRG

SEQ ID NO: 799165 - protein, 523 aa, Homo sapiens
PRRGLASTATCKSAQLDFCAGSRSCLLSLWQPSSWSLKMETNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPGVSNIRTLDTPFRKNCSFSTPVPLSLGKLLPYEPENYPYQLGEISSLPCPGGRLGGGGGRMTPF

SEQ ID NO: 799166 - protein, 400 aa, Homo sapiens
PRRGLASTATCKSAQLDFCAGSRSCLLSLWQPSSWSLKMETNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQIW

SEQ ID NO: 799167 - protein, 444 aa, Homo sapiens
PRRGLASTATCKSAQLDFCAGSRSCLLSLWQPSSWSLKMETNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKHLVNTQ

SEQ ID NO: 799168 - protein, 107 aa, Homo sapiens
PRRGLASTATCKSAQLDFCAGSRSCLLSLWQPSSWSLKMETNESTEGSRSRSRSLDIQPSSEGLGPTSEPFPSSDDSPREPPTTWIKSQACRMALRVFSSDTDTGDC

SEQ ID NO: 799169 - protein, 141 aa, Homo sapiens
GSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEEVLKFWPAPFS

SEQ ID NO: 799170 - protein, 464 aa, Homo sapiens
PRRGLASTATCKSAQLDFCAGSRSCLLSLWQPSSWSLKMETNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPVCEGD

SEQ ID NO: 799171 - protein, 517 aa, Homo sapiens
PRRGLASTATCKSAQLDFCAGSRSCLLSLWQPSSWSLKMETNESTEGSRSRSRSLDIQPSSEGLGPTSEPFPSSDDSPRSALAAATAAAAAAASAAAATAAFTTAKAAALSTKTPAPCSEFMEPSSDPSLLGEPCAGPGFTHNIAHGSLGFEPVYVSCIAQDTCTTTDHSSNPGPVPGSSSGPVLGSSSGAGHGSGSGSGPGCGSVPGSGSGPGPGSGPGSGPGHGSGSHPGPASGPGPDTGPDSELSPCIPPGFRNLVADRVPNYTSWSQHCPWEPQKQPPWEFLQVLEPGARGLWKPPDIKGKLMVCYETLPRGQCLLYNWEEERATNHLDQVPSMQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKEQPETFWIQRAPQLPGVSNIRTLDTPFRKNCSFSTPVPLSLGKLLPYEPENYPYQLGEISSLPCPGGRLGGGGGRMTPF

SEQ ID NO: 799172 - protein, 186 aa, Homo sapiens
MQDGSESFFFRHGHRGLLTMQLKSPMPSSTTQKDSYQPPGNVYWPLRGKREAMLEMLLQHQICKEVQAEQEPTRKLFEVESVTHHDYRMELAQAGTPAPTKPHDYRQEQPETFWIQRAPQLPGVSNIRTLDTPFRKNCSFSTPVPLSLGKLLPYEPENYPYQLGEISSLPCPGGRLGGGGGRMTPF

SEQ ID NO: 799173 - protein, 133 aa, Homo sapiens
MALTPLGLHSKEVQAEQEPTRKLFEVESVTHHDYRMELAQAGTPAPTKPHDYRQEQPETFWIQRAPQLPGVSNIRTLDTPFRKNCSFSTPVPLSLGKLLPYEPENYPYQLGEISSLPCPGGRLGGGGGRMTPF

SEQ ID NO: 799174 - protein, 915 aa, Homo sapiens
MRKSSSPSLSNCNSVLANKIFGIPLDELQQGGHPDNEVPFIVRHVVDYIEEHGGLEQQGLFQVNGNAETVEWLRQRYDSGEEVDLVKEADVPSAISLLRFFLQELPEPVIPGSLHIHLMQLSQDYNNEDEFGRKLRFLLQQLPPVNYSLLKFLCRFLANVASHHEEIWSANSLAAVFGPDVFHIYTDVEDMKEQEIVSRIMAGLLENYYEFFENEEEDFSSNDLSSITEQVNELSEEEEEDEKLEHIEELPEEGAEKSNDMPEVVQLRMTENILESNSVTATSTHISPISILPASTDILERTIRAAVEQHLFDLQSSIDHDLKNLQQQSVVCNNEAESIHCDGEGSNNQIDIADDIINASESNRDCSKPVASTNLDNEAMQQDCVFENEENTQSVGILLEPCSDRGDSEDGCLEREEYLLFDSDKLSHLILDSSSKICDLNANTESEVPGGQSVGVQGEAACVSIPHLDLKNVSDGDKWEEPFPAFKSWQEDSESGEAQLSPQAGRMNHHPLEEDCPPVLSHRSLDFGQSQRFLHDPEKLDSSSKALSFTRIRRSSFSSKDEKREDRTPYQLVKKLQKKIRQFEEQFERERNSKPSYSDIAANPKVLKWMTELTKLRKQIKDAKHKNSDGEFVPQTRPRSNTLPKSFGSSLDHEDEENEDEPKVIQKEKKPSKEATLELILKRLKEKRIERCLPEDIKKMTKDHLVEEKASLQKSLLYYESQHGRPVTKEERHIVKPLYDRYRLVKQMLTRASITPVLGSPSTKRRGQMLQPIIEGETAHFFEEIKEEEEDGVNLSSELGDMLKTAVQVQSSLENSESDVEENQEKLALDLRLSSSRAASMPELLEQLWKARAEKKKLRKTLREFEEAFYQQNGRNAQKEDRVPVLEEYREYKKIKAKLRLLEVLISKQDSSKSI

SEQ ID NO: 799175 - protein, 915 aa, Homo sapiens; identical to SEQ ID NO: 799174

SEQ ID NO: 799176 - protein, 797 aa, Homo sapiens
MQLSQDYNNEDEFGRKLRFLLQQLPPVNYSLLKFLCRFLANVASHHEEIWSANSLAAVFGPDVFHIYTDVEDMKEQEIVSRIMAGLLENYYEFFENEEEDFSSNDLSSITEQVNELSEEEEEDEKLEHIEELPEEGAEKSNDMPEVVQLRMTENILESNSVTATSTHISPISILPASTDILERTIRAAVEQHLFDLQSSIDHDLKNLQQQSVVCNNEAESIHCDGEGSNNQIDIADDIINASESNRDCSKPVASTNLDNEAMQQDCVFENEENTQSVGILLEPCSDRGDSEDGCLEREEYLLFDSDKLSHLILDSSSKICDLNANTESEVPGGQSVGVQGEAACVSIPHLDLKNVSDGDKWEEPFPAFKSWQEDSESGEAQLSPQAGRMNHHPLEEDCPPVLSHRSLDFGQSQRFLHDPEKLDSSSKALSFTRIRRSSFSSKDEKREDRTPYQLVKKLQKKIRQFEEQFERERNSKPSYSDIAANPKVLKWMTELTKLRKQIKDAKHKNSDGEFVPQTRPRSNTLPKSFGSSLDHEDEENEDEPKVIQKEKKPSKEATLELILKRLKEKRIERCLPEDIKKMTKDHLVEEKASLQKSLLYYESQHGRPVTKEERHIVKPLYDRYRLVKQMLTRASITPVLGSPSTKRRGQMLQPIIEGETAHFFEEIKEEEEDGVNLSSELGDMLKTAVQVQSSLENSESDVEENQEKLALDLRLSSSRAASMPELLEQLWKARAEKKKLRKTLREFEEAFYQQNGRNAQKEDRVPVLEEYREYKKIKAKLRLLEVLISKQDSSKSI

SEQ ID NO: 799177 - protein, 915 aa, Homo sapiens; identical to SEQ ID NO: 799174

SEQ ID NO: 799178 - protein, 915 aa, Homo sapiens; identical to SEQ ID NO: 799174

SEQ ID NO: 799179 - protein, 915 aa, Homo sapiens; identical to SEQ ID NO: 799174

SEQ ID NO: 799180 - protein, 142 aa, Homo sapiens
EKRLPGPPMLRSQSQARARSRGSRSALGAPPRPRPPRPSRPPAPPAPHCARVCGAGRKGRRSRAGAGTEAWRAGLGRFRACQGKAGEEAGGGRREERSNGVLLRFDILKRSLDSLPGAGMAACAMVGDQRGARAGAGERGGR

SEQ ID NO: 799181 - protein, 222 aa, Homo sapiens
MAASVRQARSLLGVAATLAPGSRGYRARPPPRRRPGPRWPDPEDLLTPRWQLGPRYAAKQFARYGAASGVVPGSLWPSPEQLRELEAEEREWYPSLATMQESLRVKQLAEEQKRREREQHIAECMAKMPQMIVNWQQQQRENWEKAQADKERRARLQAEAQELLGYQVDPRSARFQELLQDLEKKERKRLKEEKQKRKKEARAAALAAAVAQDPAASGAPSS

SEQ ID NO: 799182 - protein, 222 aa, Homo sapiens; identical to SEQ ID NO: 799181

SEQ ID NO: 799183 - protein, 233 aa, Homo sapiens
RTRLVEPGVIRRGASVRQARSLLGVAATLAPGSRGYRARPPPRRRPGPRWPDPEDLLTPRWQLGPRYAAKQFARYGAASGVVPGSLWPSPEQLRELEAEEREWYPSLATMQESLRVKQLAEEQKRREREQHIAECMAKMPQMIVNWQQQQRENWEKAQADKERRARLQAEAQELLGYQVDPRSARFQELLQDLEKKERKRLKEEKQKRKKEARAAALAAAVAQDPAASGAPSS

SEQ ID NO: 799184 - protein, 86 aa, Homo sapiens
VIYDPYDTRYAAKQFARYGAASGVVPGSLWPSPEQLRELEAEEREWYPSLATMQESLRVKQLAEEQKRRERSSTSRSALSIGIHQK

SEQ ID NO: 799185 - protein, 233 aa, Homo sapiens; identical to SEQ ID NO: 799183

SEQ ID NO: 799186 - protein, 222 aa, Homo sapiens; identical to SEQ ID NO: 799181

SEQ ID NO: 799187 - protein, 222 aa, Homo sapiens; identical to SEQ ID NO: 799181

SEQ ID NO: 799188 - protein, 192 aa, Homo sapiens
RLLSWRYPLCNPEDLLTPRWQLGPRYAAKQFARYGAASGVVPGSLWPSPEQLRELEAEEREWYPSLATMQESLRVKQLAEEQKRREREQHIAECMAKMPQMIVNWQQQQRENWEKAQADKERRARLQAEAQELLGYQVDPRSARFQELLQDLEKKERKRLKEEKQKRKKEARAAALAAAVAQDPAASGAPSS

SEQ ID NO: 799189 - protein, 126 aa, Homo sapiens
RTRLVEPGVIRRGASVRQARSLLGVAATLAPGSRGYRARPPPRRRPGPRWPDPEDLLTPRWQLGPRYAAKQFARYGAASGVVPGSLWPSPEQLREGAAHRRVHGQDATDDCELAAAAAGELGEGPG

SEQ ID NO: 799190 - protein, 109 aa, Homo sapiens
GLASQPTSFSCAGCSLPSNIELQVLQFWDSDWLSLSACRQPIVGPCDHILPEEIPWSLKWFCISTEIYKSGCLLPLSHFSSSCSSSSIGSSVSSGVGIKKCGLRGGLLT

SEQ ID NO: 799191 - protein, 285 aa, Homo sapiens
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQLYKFGETVSIVFWTDTWRPESFFDKVKKNRQNGMHTLCLLDIKVKEQSLENLIKGRKIYEPPRYMSVNQAAQQLLEIVQNQRIRGEEPAVTEETLCVGLARVGADDQKIAAGTLRQMCTVDLGEPLHSLIITGGSIHPMEMEMLSLFSIPENSSESQSINGL

SEQ ID NO: 799192 - protein, 159 aa, Homo sapiens
MLHSLWLVIHLDTWRPESFFDKVKKNRQNGMHTLCLLDIKVKEQSLENLIKGRKIYEPPRYMSVNQAAQQLLEIVQNQRIRGEEPAVTEETLCVGLARVGADDQKIAAGTLRQMCTVDLGEPLHSLIITGGSIHPMEMEMLSLFSIPENSSESQSINGL

SEQ ID NO: 799193 - protein, 285 aa, Homo sapiens; identical to SEQ ID NO: 799191

SEQ ID NO: 799194 - protein, 172 aa, Homo sapiens
MNAVGCCGLQLYKFGETVSIVFWTDTWRPESFFDKVKKNRQNGMHTLCLLDIKVKEQSLENLIKGRKIYEPPRYMSVNQAAQQLLEIVQNQRIRGEEPAVTEETLCVGLARVGADDQKIAAGTLRQMCTVDLGEPLHSLIITGGSIHPMEMEMLSLFSIPENSSESQSINGL

SEQ ID NO: 799195 - protein, 240 aa, Homo sapiens
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQLYKFGETVSIVFWTDTWRPESFFDKVKKNRQNGMHTLCLLDIKVKEQSLENLINSYRGDTLCWLSQGWSRRPENCSRHFKANVHCGLGRTIAFLDHHRRQHTSNGDGDAKSVFHTRK

SEQ ID NO: 799196 - protein, 159 aa, Homo sapiens; identical to SEQ ID NO: 799192

SEQ ID NO: 799197 - protein, 194 aa, Homo sapiens
DSSKEMRRVNGGNPFMKPSDLVRTHYHENSMELYKFGETVSIVFWTDTWRPESFFDKVKKNRQNGMHTLCLLDIKVKEQSLENLIKGRKIYEPPRYMSVNQAAQQLLEIVQNQRIRGEEPAVTEETLCVGLARVGADDQKIAAGTLRQMCTVDLGEPLHSLIITGGSIHPMEMEMLSLFSIPENSSESQSINGL

SEQ ID NO: 799198 - protein, 137 aa, Homo sapiens
AGIRFSKDCSFTLMSSKHNVCMPFCLFFFTLSKKLSGLQVSVNQAAQQLLEIVQNQRIRGEEPAVTEETLCVGLARVGADDQKIAAGTLRQMCTVDLGEPLHSLIITGGSIHPMEMEMLSLFSIPENSSESQSINGL

SEQ ID NO: 799199 - protein, 234 aa, Homo sapiens
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQLYKFGETVSIVFWTDTWRPESFFDKVKKNRQNGMHTLCLLDIKVKEQSLENLIKGRKIYEPPRYMSVNQAAQQLLEIVQNQRIRGEEPAVTEETLCVGLARVGADDQIAGA

SEQ ID NO: 799200 - protein, 234 aa, Homo sapiens; identical to SEQ ID NO: 799199

SEQ ID NO: 799201 - protein, 105 aa, Homo sapiens
MLYLIGLGLGDAKDITVKGLEVVRRCSRVYLEAYTSVLTVGKEALEEFYGRKLVVADREEVEQEADNILKDADISDVAFLVVGDPFGVSQGRYFEFLTHLLFFNQ

SEQ ID NO: 799202 - protein, 285 aa, Homo sapiens; identical to SEQ ID NO: 799191

SEQ ID NO: 799203 - protein, 285 aa, Homo sapiens; identical to SEQ ID NO: 799191

SEQ ID NO: 799204 - protein, 172 aa, Homo sapiens; identical to SEQ ID NO: 799194

SEQ ID NO: 799205 - protein, 172 aa, Homo sapiens; identical to SEQ ID NO: 799194

SEQ ID NO: 799206 - protein, 259 aa, Homo sapiens
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQLYKFGETVSIVFWTDTWRPESFFDKVKKGRKIYEPPRYMSVNQAAQQLLEIVQNQRIRGEEPAVTEETLCVGLARVGADDQKIAAGTLRQMCTVDLGEPLHSLIITGGSIHPMEMEMLSLFSIPENSSESQSINGL

SEQ ID NO: 799207 - protein, 237 aa, Homo sapiens
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQLYKFGETVSIVFWTDTWRPESFFDKVKKNRQNGMHTLCLLAVTEETLCVGLARVGADDQKIAAGTLRQMCTVDLGEPLHSLIITGGSIHPMEMEMLSLFSIPENSSESQSINGL

SEQ ID NO: 799208 - protein, 159 aa, Homo sapiens; identical to SEQ ID NO: 799192

SEQ ID NO: 799209 - protein, 120 aa, Homo sapiens
MNAVGCCGLQLYKFGETVSIVFWTDTWRPESFFDKVKKNRQNGMHTLCLLDIKVKEQSLENLIKGRKIYEPPRYMSVNQAAQQLLEIVQNQRIRGEEPAVTEETLCVGLARVGADDHCIP

SEQ ID NO: 799210 - protein, 144 aa, Homo sapiens
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQLYKLVLTDCLSFCLISPSSNL

SEQ ID NO: 799211 - protein, 267 aa, Homo sapiens
LVQAQPCHSPEKATSEWGLQALWPQEERAGGPLSPLLGQLPCPSPASGTLIISVGLFWGLLGFISRVENLEGPSWQSQGWGQRDPIPSALNLCFTQSPSESWELALSTPRGGPQAHPGCPSMAPAASALHPSRPSLLLMVTSACLSTGSSPRPGPLLPWKPSKRPLVAPQRVLAGLCQVQGPVGGQQEPRRPSAQEQTHMATLVRSATGSVVERWNVCTVTSAEYENWPVAGYKQDDALAVGHVGGEVQGQLEVRGCLFQVDDVVVQ

SEQ ID NO: 799212 - protein, 67 aa, Homo sapiens
MEPSMAARSFSGSLSARSGWYSLVLLEDALCLKAAVTKASQEAATDPSGSTRHTASSPAVGGGPGGA

SEQ ID NO: 799213 - protein, 89 aa, Homo sapiens
IRVLARCSPGSDGREGRGIPTAATALSASARMYMKHGTNSCSCEASRSLQSWQKLKGEPACGMAREGARERGRSCQALLNNQISRELTD

SEQ ID NO: 799214 - protein, 442 aa, Homo sapiens
MGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYGESTARAWQGGDAKSPTQTLLSSRRGPTVL

SEQ ID NO: 799215 - protein, 433 aa, Homo sapiens
MGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYEAPPSYEQSCGGVEPSLTPES

SEQ ID NO: 799216 - protein, 432 aa, Homo sapiens
MGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYGESTARAWQGGSWDLERQLL

SEQ ID NO: 799217 - protein, 442 aa, Homo sapiens; identical to SEQ ID NO: 799214

SEQ ID NO: 799218 - protein, 442 aa, Homo sapiens; identical to SEQ ID NO: 799214

SEQ ID NO: 799219 - protein, 395 aa, Homo sapiens
MQCPLLSWPCGHLRPPQGGTAPHLPPVSAGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYGESTARAWQGGDAKSPTQTLLSSRRGPTVL

SEQ ID NO: 799220 - protein, 608 aa, Homo sapiens
AGCTGSQVPYECGGRGMGRVQLFEISLSHGRVVYSPGEPLAGTVRVRLGAPLPFRAIRVTCIGSCGVSNKANDTAWVVEEGYFNSSLSLADKGKFGSQFPSGDPWGQPLEWGLSVLSSPFPRSASWIWHWPILSQVVGPDGFLIGAGWLKGPPPPCAGFGWALTPGTAVHPCPIPKPLSCSSQALILSPSPKPQPCAAVALVTETGRPSVSWSAAVPTLILALWPPQPPQGGTAPHLPPVSAGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYGESTARAWQGGDAKSPTQTLLSSRRGPTVL

SEQ ID NO: 799221 - protein, 317 aa, Homo sapiens
MPQGSSLRTPAKPLPGPPPKQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYGESTARAWQGGDAKSPTQTLLSSRRGPTVL

SEQ ID NO: 799222 - protein, 397 aa, Homo sapiens
MMVAVSFLECGRVLPCLTDLSTGQQEDAPLAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYGESTARAWQGGDAKSPTQTLLSSRRGPTVL

SEQ ID NO: 799223 - protein, 317 aa, Homo sapiens; identical to SEQ ID NO: 799221

SEQ ID NO: 799224 - protein, 474 aa, Homo sapiens
QAVLAPKFLMSGGRGMGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEGSSLRTPAKPLPGPPPKQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYGESTARAWQGGDAKSPTQTLLSSRRGPTVL

SEQ ID NO: 799225 - protein, 130 aa, Homo sapiens [sequence omitted]

SEQ ID NO: 799226 - protein, 429 aa, Homo sapiens
MGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPSSPWGWGGGGRELGPGETTPVNKTLYL

SEQ ID NO: 799227 - protein, 317 aa, Homo sapiens; identical to SEQ ID NO: 799221

SEQ ID NO: 799228 - protein, 422 aa, Homo sapiens
MSSEVAWAACSLAFPGPCPAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYGESTARAWQGGDAKSPTQTLLSSRRGPTVL

SEQ ID NO: 799229 - protein, 458 aa, Homo sapiens
MGRVQLFEISLSHGRVVYSPGEPLAGTVRVRLGAPLPFRAIRVTCIGSCGVSNKANDTAWVVEEGYFNSSLSLADKGHLRGGLPPTSLLLSAGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYGESTARAWQGGDAKSPTQTLLSSRRGPTVL

SEQ ID NO: 799230 - protein, 425 aa, Homo sapiens
MGRVQLFEISLSHGRVVYSPGEPLAGTVRVRLGAPLPFRAIRVTCIGSCGVSNKANDTAWVVEEGYFNSSLSLADKATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYGESTARAWQGGDAKSPTQTLLSSRRGPTVL

SEQ ID NO: 799231 - protein, 317 aa, Homo sapiens; identical to SEQ ID NO: 799221

SEQ ID NO: 799232 - protein, 194 aa, Homo sapiens
LRFAPLSRSILLSASALLLSSARLPGPARRGRLALVSLFLPPPFVFCLPLYLLMFPSPPRPLSFLCYSSVLSRSWLPPLLSSSALSSSWLSPCAAVLFVFRVPVASSLLPLLLPSPVLPVSFGPSLRRAWLAGVASLSFLLLRLLSFSLSCLSLSLSLCFLFVFFILFFFFPFFVFLFFFFFFFFFFFFFFSCK

SEQ ID NO: 799233 - protein, 273 aa, Homo sapiens
MGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQSQVSIFND

SEQ ID NO: 799234 - protein, 147 aa, Homo sapiens
MGDALPPFPGAQPLTGRAWLGSSPVMYLHSHGKVAHGALAAAEVEAVQMEEDILQLQAEATAEVLGEVAQAQKVLRDSVQRLEVQLRSAWLGPAYREFEVLKAHADKQSHILWALTGHVQRQRREMVAQQHRLRQIQERLHTAALPA

SEQ ID NO: 799235 - protein, 144 aa, Homo sapiens
MPVPALCLLWALAMVTRPASAAPMGGPELAQHEELTLLFHGTLQLGQALNGVYRTTEGRLTKARNSLGLYGRTIELLGQEVSRGRDAAQELRASLLETQAHADKQSHILWALTGHVQRQRREMVAQQHRLRQIQERLHTAALPA

SEQ ID NO: 799236 - protein, 198 aa, Homo sapiens
MPVPALCLLWALAMVTRPASAAPMGGPELAQHEELTLLFHGTLQLGQALNGVYRTTEGRLTKARNSLGLYGRTIELLGQEVSRGRDAAQELRASLLETQMEEDILQLQAEATAEVLGEVAQAQKVLRDSVQRLEVQLRSAWLGPAYREFEVLKAHADKQSHILWALTGHVQRQRREMVAQQHRLRQIQERLHTAALPA

SEQ ID NO: 799237 - protein, 220 aa, Homo sapiens
MNGFTPDEMSRGGDAAAAVAAVVAAAAAAASAGNGTGAGTGAEVPGAGAVSAAGPPGAAGPGPGQLCCLREDGERCGRAAGNASFSKRIQKSISQKKVKIELDKSARHLYICDYHKNLIQSVRNRRKRKGSDDDGGDSPVQDIDTPEVDLYQLQVNTLRRYKRHFKLPTRPGLNKAQLVEIVGCHFRSIPVNEKDTLTYFIYSVKNDKNKSDLKVDSGVH

SEQ ID NO: 799238 - protein, 220 aa, Homo sapiens; identical to SEQ ID NO: 799237

SEQ ID NO: 799239 - protein, 102 aa, Homo sapiens
PLANALGRKRKGSDDDGGDSPVQDIDTPEVDLYQLQVNTLRRYKRHFKLPTRPGLNKAQLVEIVGCHFRSIPVNEKDTLTYFIYSVKNDKNKSDLKVDSGVH

SEQ ID NO: 799240 - protein, 220 aa, Homo sapiens; identical to SEQ ID NO: 799237

SEQ ID NO: 799241 - protein, 102 aa, Homo sapiens; identical to SEQ ID NO: 799239

SEQ ID NO: 799242 - protein, 202 aa, Homo sapiens
FSRRHLGFQAGSSCRLTLQLGGMDWPHNLLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 799243 - protein, 202 aa, Homo sapiens; identical to SEQ ID NO: 799242

SEQ ID NO: 799244 - protein, 69 aa, Homo sapiens
LAGLLVVAGHLDEALVEREVVADAVLPALLVLPVEGEAVHDELVDAVQGFLAPFLAVHRLRIRFSAKGC

SEQ ID NO: 799245 - protein, 100 aa, Homo sapiens
PAGPAERQPLPWRVVSRDQGVAGGAERRGTDGYIRGISPHIQNVLKAPKIFIMSDYQKLEVTLLYLGELAPQAFEIPAFCPALHRPRISKAVSPFSITTR

SEQ ID NO: 799246 - protein, 146 aa, Homo sapiens
QLRHSSLEQSSQTWRSAPSKTSTASATTSSAKSAASTKATTTASSTSSFRFCRRRDTRQTMPPGLAQKWTGEAKKDTAGLVTAAGKQELRQFGRVPFKVGGLENENFKFHSSNSSSHVWRICWIQGSILAWSLTPKTAEASIAVLI

SEQ ID NO: 799247 - protein, 101 aa, Homo sapiens
CTVSLSTFEVLALGLIHHWLPRSPACRRPIVGLHLVIRGQFAILSSSGSGSDVGDQHLPLPMAYGTHVQHESGYLPNKTHSNTAEYVQTKTSMLMKFLQIL

SEQ ID NO: 799248 - protein, 926 aa, Homo sapiens
MLKLDNKDVISHPLGYPSESLLSIASMLDSSDSSSQPHWSNELIAEQLQQQVSQLQDQLDAELEDKRKVLLELSREKAQNEDLKLEVTNILQKHKQEVELLQNAATISQPPDRQSEPATHPAVLQENTQIEPSEPKNQEEKKLSQVLNELQVSHAETTLELEKTRDMLILQRKINVCYQVQGKMVQEGDGNRNVGTTHRTGNEARPKFPGLIPEELEAMMTKADNDNRDHKEKLERLTRLLDLKNNRIKQLEGILEAMTFQHLGENLFELHIHQAFLTSAALAQAGDTQPTTFCTYSFYDFETHCTPLSVGPQPLYDFTSQYVMETDSLFLHYLQEASARLDIHQAMASEHSTLAAGWICFDRVLETVEKVHGLATLIGAGGEEFGVLEYWMRLRFPIKPSLQACNKRKKAQVYLSTDVLGGRKAQEEEFRSESWEPQNELWIEITKCCGLRSRWLGTQPSPYAVYRFFTFSDHDTAIIPASNNPYFRDQARFPVLVTSDLDHYLRREALSIHVFDDEDLEPGSYLGRARVPLLPLAKNESIKGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 799249 - protein, 883 aa, Homo sapiens
MLKLDNKDVISHPLGYPSESLLSIASMLDSSDSSSQPHWSNELIAEQLQQQVSQLQDQLDAELEDKRKVLLELSREKAQNEDLKLEVTNILQKHKQEVELLQNAATISQPPDRQSEPATHPAVLQENTQIEPSEPKNQEEKKLSQVLNELQVSHAETTLELEKTRDMLILQRKINVCYQEELEAMMTKADNDNRDHKEKLERLTRLLDLKNNRIKQLEERAPYPLRIGSFLSPLEQLKDVAYGTRPLSLCLETLPAHGDEDKVDISLLHQPLYDFTSQYVMETDSLFLHYLQEASARLDIHQAMASEHSTLAAGWICFDRVLETVEKVHGLATLIGAGGEEFGVLEYWMRLRFPIKPSLQACNKRKKAQVYLSTDVLGGRKAQEEEFRSESWEPQNELWIEITKCCGLRSRWLGTQPSPYAVYRFFTFSDHDTAIIPASNNPYFRDQARFPVLVTSDLDHYLRREALSIHVFDDEDLEPGSYLGRARVPLLPLAKNESIKGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 799250 - protein, 928 aa, Homo sapiens
MLKLDNKDVISHPLGYPSESLLSIASMLDSSDSSSQPHWSNELIAEQLQQQVSQLQDQLDAELEDKRKVLLELSREKAQNEDLKLEVTNILQKHKQEVELLQNAATISQPPDRQSEPATHPAVLQENTQIEPSEPKNQEEKKLSQVLNELQVSHAETTLELEKTRDMLILQRKINVCYQEELEAMMTKADNDNRDHKEKLERLTRLLDLKNNRIKQLEGILRSHDLPTSEQLKDVAYGTRPLSLCLETLPAHGDEDKVDISLLHQGENLFELHIHQAFLTSAALAQAGDTQPTTFCTYSFYDFETHCTPLSVGPQPLYDFTSQYVMETDSLFLHYLQEASARLDIHQAMASEHSTLAAGWICFDRVLETVEKVHGLATLIGAGGEEFGVLEYWMRLRFPIKPSLQACNKRKKAQVYLSTDVLGGRKAQEEEFRSESWEPQNELWIEITKCCGLRSRWLGTQPSPYAVYRFFTFSDHDTAIIPASNNPYFRDQARFPVLVTSDLDHYLRREALSIHVFDDEDLEPGSYLGRARVPLLPLAKNESIKGDFNLTDPAEKPNGSIQVQLDWKFPYIPPESFLKPEAQTKGKDTKDSSKISSEEEKASFPSQDQMASPEVPIEAGQYRSKRKPPHGGERKEKEHQVVSYSRRKHGKRIGVQGKNRMEYLSLNILNGNTPEQVNYTEWKFSETNSFIGDGFKNQHEEEEMTLSHSALKQKEPLHPVNDKESSEQGSEVSEAQTTDSDDVIVPPMSQKYPKADSEKMCIEIVSLAFYPEAEVMSDENIKQVYVEYKFYDLPLSETETPVSLRKPRAGEEIHFHFSKVIDLDPQEQQGRRRFLFDMLNGQDPDQGHLKFTVVSDPLDEEKKECEEVGYAYLQLWQILESGRDILEQELDIVSPEDLATPIGRLKVSLQAAAVLHAIYKEMTEDLFS

SEQ ID NO: 799251 - protein, 928 aa, Homo sapiens; identical to SEQ ID NO: 799250

SEQ ID NO: 799252 - protein, 490 aa, Homo sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKEREVQSSILYKGAAAEGRPGGSLGVHPEGQQLLGMHVVQGPQVRQLEQQLGEAGSLQGPVLQHQSPKSPQQRLLELLHRSGILHARAVCGEDDSSEADSPSSSEEEPEVCEDLAGNAASP

SEQ ID NO: 799253 - protein, 98 aa, Homo sapiens
EDPWGNLVPCVRPCASLFTVVLDDSKRVAKRKLIEQNRERRRKEEMIRSLQQRPEPTPEEWDLIHIATEAHRSTNAQGSHWKQRRKFLVRRKGAWGEQ

SEQ ID NO: 799254 - protein, 490 aa, Homo sapiens; identical to SEQ ID NO: 799252

SEQ ID NO: 799255 - protein, 490 aa, Homo sapiens; identical to SEQ ID NO: 799252

SEQ ID NO: 799256 - protein, 451 aa, Homo sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKGPQVRQLEQQLGEAGSLQGPVLQHQSPKSPQQRLLELLHRSGILHARAVCGEDDSSEADSPSSSEEEPEVCEDLAGNAASP

SEQ ID NO: 799257 - protein, 377 aa, Homo sapiens
GRVGVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKEREVQSSILYKGAAAEGRPGGSLGVHPEGQQLLGMHVVQGPQVRQLEQQLGEAGSLQGPVLQHQSPKSPQQRLLELLHRSGILHARAVCGEDDSSEADSPSSSEEEPEVCEDLAGNAASP

SEQ ID NO: 799258 - protein, 410 aa, Homo sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKVTDLRMIGACHASRFLHMKVECPTELFPPLFLEVFEDQEV

SEQ ID NO: 799259 - protein, 353 aa, Homo sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAWQHLTCPLRPQLKCHLLPQLPQAEIVVCASLVHASTVTLISLFYN

SEQ ID NO: 799260 - protein, 324 aa, Homo sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPSRKTTFPSSAGQTWPDSLAFCCVVPSAWDALPPFSAWQHLTCPLRPQLKCHLLPQLPQAEIVVCASLVHASTVTLISLFYN

SEQ ID NO: 799261 - protein, 187 aa, Homo sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIKIEKEENRKNEKGRNWKKR

SEQ ID NO: 799262 - protein, 410 aa, Homo sapiens; identical to SEQ ID NO: 799258

SEQ ID NO: 799263 - protein, 490 aa, Homo sapiens; identical to SEQ ID NO: 799252

SEQ ID NO: 799264 - protein, 475 aa, Homo sapiens
MGKSVRASLLDSKPCLPSSILSFLPGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKEREVQSSILYKGAAAEGRPGGSLGVHPEGQQLLGMHVVQGPQVRQLEQQLGEAGSLQGPVLQHQSPKSPQQRLLELLHRSGILHARAVCGEDDSSEADSPSSSEEEPEVCEDLAGNAASP

SEQ ID NO: 799265 - protein, 410 aa, Homo sapiens; identical to SEQ ID NO: 799258

SEQ ID NO: 799266 - protein, 410 aa, Homo sapiens; identical to SEQ ID NO: 799258

SEQ ID NO: 799267 - protein, 364 aa, Homo sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNRSHPSGSSRA

SEQ ID NO: 799268 - protein, 340 aa, Homo sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSEVSGRSGERCDAVLEGNLLPRSPSTGSSEVLWTRSNSCRSTYTDNIHRHTHTHAYTYTQHTGTHADTYTDTHTHLAYRYVHRHTYTHTYTQHTDTHISFL

SEQ ID NO: 799269 - protein, 179 aa, Homo sapiens
SGVRGPHPRRAVVVAVLFGVQAPRRDVAEGGLRRDGRRPGLAPQRGRGGLLLVVLHAATVQRPRLGRGPSRPPRGPVGVCRPQVAQRQRLARVCVRSLPGNRRLATRSCPAAFPLQGGATLPSSLPAPRLHLGSLLPSSSGGARLGDAAGTTHFQPAHLSHAAAPASLTDSLLRETISD

SEQ ID NO: 799270 - protein, 179 aa, Homo sapiens; identical to SEQ ID NO: 799269

SEQ ID NO: 799271 - protein, 179 aa, Homo sapiens; identical to SEQ ID NO: 799269

SEQ ID NO: 799272 - protein, 79 aa, Homo sapiens
SRSRVERPSPPPSRPLDYTWGLSFLPPREEPDWETPRGLPISSPLTFPMQQPLLHSLIHSFARPLVTEHLAHGVSGAGD

SEQ ID NO: 799273 - protein, 452 aa, Homo sapiens
MKAKIYKHIGNLKEAAKWMDEAQSLDTADRFINSKCAKYMLRANMIKEAEEMCSKFTREGTSAMENLNEMQCMWFQTECISAYQRLGRYGDALKKCHEVERHFFEITDDQFDFHTYCMRKMTLRAYVDLLRLEDILRRHAFYFKAARSAIEIYLKLYDNPLTNESKQQEINSENLSAKELKKMLSKQRRAQKKAKLEEERKHAERERQQKNQKKKRDEEEEEASGLKEELIPEKLERVENPLEEAVKFLIPLKNLVADNIDTHLLAFEIYFRKGKFLLMLQSVKRGFAINSNNPWLHECLIRFSKSVSNHSNLPDIVSKVLSQEMQKIFVKKDLESFNEDFLKRNATSLQHLLSGAKMMYFLDKSRQEKAIAIATRLDETIKDKDVKTLIKVSEALLDGSFGNCSSQYEEYRMASHNLLPFTSAFLPAVNEVDNPNVALNHTANYDVLANEI

SEQ ID NO: 799274 - protein, 426 aa, Homo sapiens
MKAKIYKHIGNLKEAAKWMDEAQSLDTADRFINSKCAKYMLRANMIKEAEEMCSKFTREGTSAMENLNEMQCMWFQTECISAYQRLGRYGDALKKCHEVERHFFEITDDQFDFHTYCMRKMTLRAYVDLLRLEDILRRHAFYFKAARSAIEIYLKLYDNPLTNESKQQEINSENLSAKELKKMLSKQRRAQKKAKLEEERKHAERERQQKNQKKKRDEEEEEASGLKEELIPEKLERVENPLEEAVKFLIPLKNLVADNIDTHLLAFEIYFRKGKFLLMLQSVKRGFAINSNNPWLHECLIRFSKSDIVSKVLSQEMQKIFVKKDLESFNEDFLKRNATSLQHLLSGATRLDETIKDKDVKTLIKVSEALLDGSFGNCSSQYEEYRMASHNLLPFTSAFLPAVNEVDNPNVALNHTANYDVLANEI

SEQ ID NO: 799275 - protein, 434 aa, Homo sapiens
MKAKIYKHIGNLKEAAKWMDEAQSLDTADRFINSKCAKYMLRANMIKEAEEMCSKFTREGTSAMENLNEMQCMWFQTECISAYQRLGRYGDALKKCHEVERHFFEITDDQFDFHTYCMRKMTLRAYVDLLRLEDILRRHAFYFKAARSAIEIYLKLYDNPLTNESKQQEINSENLSAKELKKMLSKQRRAQKKAKLEEERKHAERERQQKNQKKKRDEEEEEASGLKEELIPEKLERVENPLEEAVKFLIPLKNLVADNIDTHLLAFEIYFRKGKFLLMLQSVKRGFAINSNNPWLHECLIRFSKSVSNHSNLPDIVSKVLSQEMQKIFVKKDLESFNEDFLKRNATSLQHLLSGATRLDETIKDKDVKTLIKVSEALLDGSFGNCSSQYEEYRMASHNLLPFTSAFLPAVNEVDNPNVALNHTANYDVLANEI

SEQ ID NO: 799276 - protein, 768 aa, Homo sapiens
MDPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 799277 - protein, 768 aa, Homo sapiens; identical to SEQ ID NO: 799276

SEQ ID NO: 799278 - protein, 768 aa, Homo sapiens; identical to SEQ ID NO: 799276

SEQ ID NO: 799279 - protein, 498 aa, Homo sapiens
VVVAEICCCHNNVIWYTTDCFNVMAPREQLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 799280 - protein, 768 aa, Homo sapiens; identical to SEQ ID NO: 799276

SEQ ID NO: 799281 - protein, 768 aa, Homo sapiens; identical to SEQ ID NO: 799276

SEQ ID NO: 799282 - protein, 120 aa, Homo sapiens
MSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 799283 - protein, 165 aa, Homo sapiens
YEDPRNRDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 799284 - protein, 768 aa, Homo sapiens; identical to SEQ ID NO: 799276

SEQ ID NO: 799285 - protein, 163 aa, Homo sapiens [sequence omitted]

SEQ ID NO: 799286 - protein, 689 aa, Homo sapiens
MDPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNEVGKCEQLFIW

SEQ ID NO: 799287 - protein, 773 aa, Homo sapiens
MDPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPSIEVGSAPSCSELFLPVSV

SEQ ID NO: 799288 - protein, 626 aa, Homo sapiens
MDPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAHGTPSLHAATRSTDPRL

SEQ ID NO: 799289 - protein, 390 aa, Homo sapiens
MDPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQPLQGSSRR

SEQ ID NO: 799290 - protein, 209 aa, Homo sapiens
MDPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQHWSEEISTVAVITICIFILIQLYHFVQQRREDYAQQLENIAHSVRKPLSQAVLDVNL

SEQ ID NO: 799291 - protein, 125 aa, Homo sapiens
PVSSIAQVADIDGQYAMTRAQRVRAAMFPETLDEGMQIPSTQFDAAHPTNVQRLAEPSQMLKHAVVMAIKQHTNPRGEPSIFTRAGMPPDLKMAVSPHDDGKGYARSQRYTSCFYIICILRVRHM

SEQ ID NO: 799292 - protein, 110 aa, Homo sapiens
FLLLPPPSHWPLIKATVGLIRNLALCPANHAPLREQGAIPRLVQLLVRAHQDTQRRTSMGGTQQQFVEGVRMEEIVEGCTGALHILARDVHNRQFLSQIAMTITHRLYRC

SEQ ID NO: 799293 - protein, 710 aa, Homo sapiens
PVSSIAQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 799294 - protein, 768 aa, Homo sapiens; identical to SEQ ID NO: 799276

SEQ ID NO: 799295 - protein, 768 aa, Homo sapiens; identical to SEQ ID NO: 799276

SEQ ID NO: 799296 - protein, 640 aa, Homo sapiens
MDPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVGK

SEQ ID NO: 799297 - protein, 768 aa, Homo sapiens; identical to SEQ ID NO: 799276

SEQ ID NO: 799298 - protein, 226 aa, Homo sapiens
TLGIPSEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 799299 - protein, 768 aa, Homo sapiens; identical to SEQ ID NO: 799276

SEQ ID NO: 799300 - protein, 163 aa, Homo sapiens [sequence omitted]

SEQ ID NO: 799301 - protein, 90 aa, Homo sapiens
QFLHITVLLGSQREPLGYRQDDPSYRSFHSGGYGQDALGMDPMMEHEMGGHHPGADYPVDGLPDLGHAQDLMDGLPPGDSNQLAWFDTDL

SEQ ID NO: 799302 - protein, 640 aa, Homo sapiens; identical to SEQ ID NO: 799296

SEQ ID NO: 799303 - protein, 188 aa, Homo sapiens [sequence omitted]

SEQ ID NO: 799304 - protein, 188 aa, Homo sapiens [sequence omitted]

SEQ ID NO: 799305 - protein, 188 aa, Homo sapiens [sequence omitted]

SEQ ID NO: 799306 - protein, 188 aa, Homo sapiens [sequence omitted]

SEQ ID NO: 799307 - protein, 152 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHHYREQIKRVKDSEDVPMVLVGNKCDLPSRTVDTKQAQDLARSYGIPFIETSAKTRQGK

SEQ ID NO: 799308 - protein, 188 aa, Homo sapiens [sequence omitted]

SEQ ID NO: 799309 - protein, 183 aa, Homo sapiens
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHHYREQIKRVKDSEDVPMVLVGNKCDLPSRTVDTKQAQDLARSYGIPFIETSAKTRQESGGCFLYIGEGDPTIQIEKNQQRRKDSWLCEN

SEQ ID NO: 799310 - protein, 575 aa, Homo sapiens
MDFPTISRSPSGPPAMDLEGPRDILVPSEDLTPDSQWDPMPGGPGSLSRMELDESSLQELVQQFEALPGDLVGPSPGGAPCPLHIATGHGLASQEIADAHGLLSAEAGRDDLLGLLHCEECPPSQTGPEEPLEPAPRLLQPPEDPDEDSDSPEWVEGASAEQEGSRSSSSSPEPWLETVPLVTPEEPPAGAQSPETLASYPAPQEVPGPCDHEDLLDGVIFGARYLGSTQLVSERNPPTSTRMAQAREAMDRVKAPDGETQPMTEVDLFVSTKRIKVLTADSQEAMMDHALHTISYTADIGCVLVLMARRRLARRPAPQDHGRRLYKMLCHVFYAEDAQLIAQAIGQAFAAAYSQFLRESGIDPSQVGVHPSPGACHLHNGDLDHFSNSDNCREVHLEKRRGEGLGVALVESGWGSLLPTAVIANLLHGGPAERSGALSIGDRLTAINGTSLVGLPLAACQAAVRETKSQTSVTLSIVHCPPVTTAIIHRPHAREQLGFCVEDGIICSLLRGGIAERGGIRVGHRIIEINGQSVVATPHARIIELLTEAYGEVHIKTMPAATYRLLTGQEQPVYL

SEQ ID NO: 799311 - protein, 71 aa, Homo sapiens
PLRRPSALRRPSALRRLHGGPAERSGALSIGDRLTAINGTSLVGLPLAACQAAVRVSFLVWQGPHTPRKGS

SEQ ID NO: 799312 - protein, 650 aa, Homo sapiens
MDFPTISRSPSGPPAMDLEGPRDILVPSEDLTPDSQWDPMPGGPGSLSRMELDESSLQELVQQFEALPGDLVGPSPGGAPCPLHIATGHGLASQEIADAHGLLSAEAGRDDLLGLLHCEECPPSQTGPEEPLEPAPRLLQPPEDPDEDSDSPEWVEGASAEQEGSRSSSSSPEPWLETVPLVTPEEPPAGAQSPETLASYPAPQEVPGPCDHEDLLDGVIFGARYLGSTQLVSERNPPTSTRMAQAREAMDRVKAPDGETQPMTEVDLFVSTKRIKVLTADSQEAMMDHALHTISYTADIGCVLVLMARRRLARRPAPQDHGRRLYKMLCHVFYAEDAQLIAQAIGQAFAAAYSQFLRESGIDPSQVGVHPSPGACHLHNGDLDHFSNSDNCREVHLEKRRGEGLGVALVESGWGSLLPTAVIANLLHGGPAERSGALSIGDRLTAINGTSLVGLPLAACQAAVRETKSQTSVTLSIVHCPPVTTAIIHRPHAREQLGFCVEDGIVRPRPLAPGWGGRAALSTAPEQPPPLSRPPLFSPRSAASSVVASPSVGASASATASLRSMGRVWWPRHTPASSSCSPRPMARCISRRCQLPHIASLQARSSPCTCDHLIPCLPLCLRLHGPGAPSWACPGWPGPQRFLVLYDFLI

SEQ ID NO: 799313 - protein, 575 aa, Homo sapiens; identical to SEQ ID NO: 799310

SEQ ID NO: 799314 - protein, 333 aa, Homo sapiens [sequence omitted]

SEQ ID NO: 799315 - protein, 176 aa, Homo sapiens
RPLPPRDGRTTRTGRTGPGDCRAAAPRMHGGPAERSGALSIGDRLTAINGTSLVGLPLAACQAAVRETKSQTSVTLSIVHCPPVTTAIIHRPHAREQLGFCVEDGIICSLLRGGIAERGGIRVGHRIIEINGQSVVATPHARIIELLTEAYGEVHIKTMPAATYRLLTGQEQPVYL

SEQ ID NO: 799316 - protein, 333 aa, Homo sapiens [sequence omitted]

SEQ ID NO: 799317 - protein, 604 aa, Homo sapiens
MDFPTISRSPSGPPAMDLEGPRDILVPSEDLTPDSQWDPMPGGPGSLSRMELDESSLQELVQQFEALPGDLVGPSPGGAPCPLHIATGHGLASQEIADAHGLLSAEAGRDDLLGLLHCEECPPSQTGPEEPLEPAPRLLQPPEDPDEDSDSPEWVEGASAEQEGSRSSSSSPEPWLETVPLVTPEEPPAGAQVVPAPPSRHPGLPGTKQGDSVLPLLIFFQSPETLASYPAPQEVPGPCDHEDLLDGVIFGARYLGSTQLVSERNPPTSTRMAQAREAMDRVKAPDGETQPMTEVDLFVSTKRIKVLTADSQEAMMDHALHTISYTADIGCVLVLMARRRLARRPAPQDHGRRLYKMLCHVFYAEDAQLIAQAIGQAFAAAYSQFLRESGIDPSQVGVHPSPGACHLHNGDLDHFSNSDNCREVHLEKRRGEGLGVALVESGWGSLLPTAVIANLLHGGPAERSGALSIGDRLTAINGTSLVGLPLAACQAAVRETKSQTSVTLSIVHCPPVTTAIIHRPHAREQLGFCVEDGIICSLLRGGIAERGGIRVGHRIIEINGQSVVATPHARIIELLTEAYGEVHIKTMPAATYRLLTGQEQPVYL

SEQ ID NO: 799318 - protein, 573 aa, Homo sapiens
MDFPTISRSPSGPPAMDLEGPRDILVPSEDLTPDSQWDPMPGGPGSLSRMELDESSLQELVQQFEALPGDLVGPSPGGAPCPLHIATGHGLASQEIADAHGLLSAEAGRDDLLGLLHCEECPPSQTGPEEPLEPAPRLLQPPEDPDEDSDSPEWVEGASAEQEGSRSSSSSPEPWLETVPLVTPEEPPAGAQSPETLASYPAPQEVPGPCDHEDLLDGVIFGARYLGSTQLVSERNPPTSTRMAQAREAMDRVKAPDGETQPMTEVDLFVSTKRIKVLTADSQEAMMDHALHTISYTADIGCVLVLMARRRLARRPAPQDHGRRLYKMLCHVFYAEDAQLIAQAIGQAFAAAYSQFLRESGIDPSQVGVHPSPGACHLHNGDLDHFSNSDNCREVHLEKRRGEGLGVALVESGWGSLLPTAVIANLLHGGPAERSGALSIGDRLTAINGTSLVGLPLAACQAAVRETKSQTSVTLSIVHCPPVTTAIIHRPHAREQLGFCVEDGIICSLLRGGIAERGGIRVGHRIIEINGQSVVATPHARIIELLTEAYGEVCGWWVVARGAPTSPTSPGLP

SEQ ID NO: 799319 - protein, 85 aa, Homo sapiens
DPDAASENAGPWMKAESPGKHEFSVDMTCGGCAEAVSRVLNKLGGVKYDIDLPNKKVCIESEHSMDTLLATLKKTGKTVSYLGLE

SEQ ID NO: 799320 - protein, 105 aa, Homo sapiens
ILNEINPLPPQPNPPSESREALLTPPPHRRHTAAASVMPKHEFSVDMTCGGCAEAVSRVLNKLGGVKYDIDLPNKKVCIESEHSMDTLLATLKKTGKTVSYLGLE

SEQ ID NO: 799321 - protein, 105 aa, Homo sapiens; identical to SEQ ID NO: 799320

SEQ ID NO: 799322 - protein, 105 aa, Homo sapiens; identical to SEQ ID NO: 799320

SEQ ID NO: 799323 - protein, 85 aa, Homo sapiens; identical to SEQ ID NO: 799319

SEQ ID NO: 799324 - protein, 105 aa, Homo sapiens
VALHGDPRVRGLHGQDPGGEALLTPPPHRRHTAAASVMPKHEFSVDMTCGGCAEAVSRVLNKLGGVKYDIDLPNKKVCIESEHSMDTLLATLKKTGKTVSYLGLE

SEQ ID NO: 799325 - protein, 105 aa, Homo sapiens; identical to SEQ ID NO: 799320

SEQ ID NO: 799326 - protein, 105 aa, Homo sapiens; identical to SEQ ID NO: 799320

SEQ ID NO: 799327 - protein, 105 aa, Homo sapiens; identical to SEQ ID NO: 799320

SEQ ID NO: 799328 - protein, 94 aa, Homo sapiens
GILLLSQNELYRQILLLMHLLPQDLLLLKPCQSSYCYCQEVLDRLIQCGLLVAEESWATQSSCSSSCRPPPRKKGSSSVRTQSSPSVLSGPSET

SEQ ID NO: 799329 - protein, 218 aa, Homo sapiens
GILLLSQNELYRQILLLMHLLPQDLLLLKPCQSSYCYCQEVLDRLIQCGLLVAEETPGSRPACDTGRQRLSRKLLWKPSGDFTDSDSDDFGEADGRYFRLSQQSHCPDFFLFLCRLLSPLLKAFAQAAAFLRQGQLPDTELGYTEQLFQFLQATAQEEGIFECADPKLAISAVWTFRDLGVLQQTPSPAGPRLHLSPTFASLDNQEKLEQFIRQFICS

SEQ ID NO: 799330 - protein, 388 aa, Homo sapiens
MAQPKQERVARARHQRSETARHQRSETAKTPTLGNRQTPTVGNRQTPTLGIHARPRRRATTSLLTLLLAFGKNAVRCALIGPGSLTSRTRPLTEPLGEKERREVFFPPRPERVEHNVESSRWEPRRRGACGSRGGNFPSPRGGSGVASLERAESSSTEPAKAIKPIDRKSVHQICSGPVVPSLSTAVKELVENSLDAGATNIDLKLKDYGVDLIEVSGNGCGVEEENFEGLTLKHHTSKIQEFADLPQVETFGFRGEALSSLCALSDVTISTCHVSAKVGTRLVFDHYGKIIQKTPYPHPRGMTVSVKQLFSTLPVHHKEFQRNIKKKRACFPFAFCRDCQFPEASPAMLPVQPAELTPRSTPPHPCSLEDNVITVFSSVKNGPGSSR

SEQ ID NO: 799331 - protein, 239 aa, Homo sapiens
MHFYLLGTEPAKAIKPIDRKSVHQICSGPVVPSLSTAVKELVENSLDAGATNIDLKLKDYGVDLIEVSGNGCGVEEENFEGLTLKHHTSKIQEFADLPQVETFGFRGEALSSLCALSDVTISTCHVSAKVGTRLVFDHYGKIIQKTPYPHPRGMTVSVKQLFSTLPVHHKEFQRNIKKKRACFPFAFCRDCQFPEASPAMLPVQPAELTPRSTPPHPCSLEDNVITVFSSVKNGPGSSR

SEQ ID NO: 799332 - protein, 328 aa, Homo sapiens
GATKAREGGACQTPTVGNRQTPTVGNRQDTNARKPPDTNGRKPPDTNARNPRQATTEGDYLPSDPAAGVRKKRSPVCSDWSRLFDVTDSTFDRATEAKRRDGKYFFRPARKGWSTTSKAAVGSPGGGAPVGAVEGTFPVPEADPVLHPWSELRARGELGSRSPLSRALFKNHGVQPPWKWGEHGRGAWRGRLVEAPERHPQRPSDPVPIRCALKPSTEPAKAIKPIDRKSVHQICSGPVVPSLSTAVKELVENSLDAGATNIDLKLKDYGVDLIEVSGNGCGVEEENFEGLMMSPFLPAMYRRRLGLDWCLITMGKSSRKPPTPTPEG

SEQ ID NO: 799333 - protein, 327 aa, Homo sapiens
MAQPKQERVARARHQRSETARHQRSETAKTPTLGNRQTPTVGNRQTPTLGIHARPRRRATTSLLTLLLAFGKNAVRCALIGPGSLTSRTRPLTEPLGEKERREVFFPPRPERVEHNVESSRWEPRRRGACGSRGGNFPSPRGGSGVASLERAESSSTEPAKAIKPIDRKSVHQICSGPVVPSLSTAVKELVENSLDAGATNIDLKLKDYGVDLIEVSGNGCGVEEENFEGLTLKHHTSKIQEFADLPQVETFGFRGEALSSLCALSDVTISTCHVSAKVGTRLVFDHYGKIIQKTPYPHPRGMTVSVKQLFSTLPVHHKEFQRNIKK

SEQ ID NO: 799334 - protein, 360 aa, Homo sapiens
MAQPKQERVARARHQRSETARHQRSETAKTPTLGNRQTPTVGNRQTPTLGIHARPRRRATTSLLTLLLAFGKNAVRCALIGPGSLTSRTRPLTEPLGEKERREVFFPPRPERVEHNVESSRWEPRRRGACGSRGGNFPSPRGGSGVASLERAESSSTEPAKAIKPIDRKSVHQICSGPVVPSLSTAVKELVENSLDAGATNIDLKLKDYGVDLIEVSGNGCGVEEENFEGLTLKHHTSKIQEFADLPQVETFGFRGEALSSLCALSDVTISTCHVSAKVGTRLVFDHYGKIIQKTPYPHPRGMTVSVKQLFSTLPVHHKEFQRNIKKPPIYSLKHVRGGPELLCKWTHCPEATMLQGSPS

SEQ ID NO: 799335 - protein, 326 aa, Homo sapiens
GATKAREGGACQTPTVGNRQTPTVGNRQDTNARKPPDTNGRKPPDTNARNPRQATTEGDYLPSDPAAGVRKKRSPVCSDWSRLFDVTDSTFDRATEAKRRDGKYFFRPARKGWSTTSKAAVGSPGGGAPVGAVEGTFPVPEADPVLHPWSELRARGELGSRSPLSRALFKNHGVQPPWKWGEHGRGAWRGRLVEAPERHPQRPSDPVPIRCALKPSTEPAKAIKPIDRKSVHQICSGPVVPSLSTAVKELVENSLDAGATNIDLKLKDYGVDLIEVSGNGCGVEEENFEGLTLKHHTSKIQEFADLPQVETFGFRGEALSSLCALR

SEQ ID NO: 799336 - protein, 208 aa, Homo sapiens
MHFYLLGTEPAKAIKPIDRKSVHQICSGPVVPSLSTAVKELVENSLDAGATNIDLKLKDYGVDLIEVSGNGCGVEEENFEGLTLKHHTSKIQEFADLPQVETFGFRGEALSSLCALSDVTISTCHVSAKVGTRLVFDHYGKIIQKTPYPHPRGMTVSVKQLFSTLPVHHKEFQRNIKKKRACFPFAFCRDCQFPEASPAMLPVQPAEL

SEQ ID NO: 799337 - protein, 68 aa, Homo sapiens
PLSRALFKNHGVQPPWKWGEHGRGAWRGRLVEAPERHPQRPSDPVPIRCALKPRQAPSGCWAAGKEFG

SEQ ID NO: 799338 - protein, 389 aa, Homo sapiens
AAPAVHVGEPVHAGGLHTERGADPVIGLYLVHRGGACQTPTVGNRQTPTLGIHARPRRRATTSLLTLLLAFGKNAVRCALIGPGSLTSRTRPLTEPLGEKERREVFFPPRPERVEHNVESSRWEPRRRGACGSRGGNFPSPRGGSGVASLERAESSSTEPAKAIKPIDRKSVHQICSGPVVPSLSTAVKELVENSLDAGATNIDLKLKDYGVDLIEVSGNGCGVEEENFEGLTLKHHTSKIQEFADLPQVETFGFRGEALSSLCALSDVTISTCHVSAKVGTRLVFDHYGKIIQKTPYPHPRGMTVSVKQLFSTLPVHHKEFQRNIKKKRACFPFAFCRDCQFPEASPAMLPVQPAELTPRSTPPHPCSLEDNVITVFSSVKNGPGSSR

SEQ ID NO: 799339 - protein, 448 aa, Homo sapiens
GATKAREGGACQTPTVGNRQTPTVGNRQDTNARKPPDTNGRKPPDTNARNPRQATTEGDYLPSDPAAGVRKKRSPVCSDWSRLFDVTDSTFDRATEAKRRDGKYFFRPARKGWSTTSKAAVGSPGGGAPVGAVEGTFPVPEADPVLHPWSELRARGELGSRSPLSRALFKNHGVQPPWKWGEHGRGAWRGRLVEAPERHPQRPSDPVPIRCALKPSTEPAKAIKPIDRKSVHQICSGPVVPSLSTAVKELVENSLDAGATNIDLKLKDYGVDLIEVSGNGCGVEEENFEGLTLKHHTSKIQEFADLPQVETFGFRGEALSSLCALSDVTISTCHVSAKVGTRLVFDHYGKIIQKTPYPHPRGMTVSVKQLFSTLPVHHKEFQRNIKKKRACFPFAFCRDCQFPEASPAMLPVQPAELTPRSTPPHPCSLEDNVITVFSSVKNGPGSSR

SEQ ID NO: 799340 - protein, 329 aa, Homo sapiens
MAQPKQERVARARHQRSETARHQRSETAKTPTLGNRQTPTVGNRQTPTLGIHARPRRRATTSLLTLLLAFGKNAVRCALIGPGSLTSRTRPLTEPLGEKERREVFFPPRPERVEHNVESSRWEPRRRGACGSRGGNFPSPRGGSGVASLERAESSSTEPAKAIKPIDRKSVHQICSGPVVPSLSTAVKELVENSLDAGATNIDLKLKDYGVDLIEVSGNGCGVEEENFEGLTLKHHTSKIQEFADLPQVETFGFRGEALSSLCALSDVTISTCHVSAKVGTRLVFDHYGKIIQKTPYPHPRGMTVSVKQLFSTLPVHHKEFQRNIKKDS

SEQ ID NO: 799341 - protein, 311 aa, Homo sapiens
MAQPKQERVARARHQRSETARHQRSETAKTPTLGNRQTPTVGNRQTPTLGIHARPRRRATTSLLTLLLAFGKNAVRCALIGPGSLTSRTRPLTEPLGEKERREVFFPPRPERVEHNVESSRWEPRRRGACGSRGGNFPSPRGGSGVASLERAESSSTEPAKAIKPIDRKSVHQICSGPVVPSLSTAVKELVENSLDAGATNIDLKLKDYGVDLIEVSGNGCGVEEENFEGLTLKHHTSKIQEFADLPQVETFGFRGEALSSLCALSDVTISTCHVSAKVGTRLVFDHYGKIIQSTLPVHHKEFQRNIKKDS

SEQ ID NO: 799342 - protein, 357 aa, Homo sapiens
MAQPKQERVARARHQRSETARHQRSETAKTPTLGNRQTPTVGNRQTPTLGIHARPRRRATTSLLTLLLAFGKNAVRCALIGPGSLTSRTRPLTEPLGEKERREVFFPPRPERVEHNVESSRWEPRRRGACGSRGGNFPSPRGGSGVASLERAESSSTEPAKAIKPIDRKSVHQICSGPVVPSLSTAVKELVENSLDAGATNIDLKLKDYGVDLIEVSGNGCGVEEENFEGLTLKHHTSKIQEFADLPQVETFGFRGEALSSLCALSDVTISTCHVSAKVGTRLVFDHYGKIIQKTPYPHPRGMTVSVKQLFSTLPVHHKEFQRNIKKKRACFPFAFCRDCQFPEASPAMLPVQPAEL

SEQ ID NO: 799343 - protein, 266 aa, Homo sapiens
MAQPKQERVARARHQRSETARHQRSETAKTPTLGNRQTPTVGNRQTPTLGIHARPRRRATTSLLTLLLAFGKNAVRCALIGPGSLTSRTRPLTEPLGEKERREVFFPPRPERVEHNVESSRWEPRRRGACGSRGGNFPSPRGGSGVASLERAESSSTEPAKAIKPIDRKSVHQICSGPVVPSLSTAVKELVENSLDAGATNIDLKLKDYGVDLIEVSGNGCGVEEENFEGLTLKHHTSKIQEFADLPQVETFGFRGEALSSLCALR

SEQ ID NO: 799344 - protein, 564 aa, Homo sapiens
PGSRDSRSSRDLSGAAPPRGVRARVLRPQGREGGDWEGGRSPFGLPYGSLRGRVVSTAQFRVPMPSASASRKSQEKPREIMDAAEDYAKERYGISSMIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGFVEIQTPKIISAASEGGANVFTVSYFKNNAYLAQSPQLYKQMCICADFEKVFSIGPVFRAEDSNTHRHLTEFVGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKYDTDFYILDKYPLAVRPFYTMPDPRNPKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 799345 - protein, 210 aa, Homo sapiens
PGSRDSRSSRDLSGAAPPRGVRARVLRPQGREGGDWEGGRSPFGLPYGSLRGRVVSTAQFRVPMPSASASRKSQEKPREIMDAAEDYAKERYGISSMIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKVSFFKI

SEQ ID NO: 799346 - protein, 81 aa, Homo sapiens
MVKFAANINKESIVDVEGVVRKVNQKIGSCTQQDVELHVQKIYVISLAEPRLPLQLDDAVRPEAEGEEEGRATAWITRRVP

SEQ ID NO: 799347 - protein, 564 aa, Homo sapiens; identical to SEQ ID NO: 799344

SEQ ID NO: 799348 - protein, 564 aa, Homo sapiens; identical to SEQ ID NO: 799344

SEQ ID NO: 799349 - protein, 564 aa, Homo sapiens; identical to SEQ ID NO: 799344

SEQ ID NO: 799350 - protein, 564 aa, Homo sapiens; identical to SEQ ID NO: 799344

SEQ ID NO: 799351 - protein, 468 aa, Homo sapiens
MIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGFVEIQTPKIISAASEGGANVFTVSYFKNNAYLAQSPQLYKQMCICADFEKVFSIGPVFRAEDSNTHRHLTEFVGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKYDTDFYILDKYPLAVRPFYTMPDPRNPKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 799352 - protein, 470 aa, Homo sapiens
MPSASASRKSQEKPREIMDAAEDYAKERYGISSMIQSQEKPGKQCFLVLRQQQFNVQALVAVGDHASKQMVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGFVEIQTPKIISAASEGGANVFTVSYFKNNAYLAQSPQLYKQMCICADFEKVFSIGPVFRAEDSNTHRHLTEFVGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKYDTDFYILDKYPLAVRPFYTMPDPRNPKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 799353 - protein, 487 aa, Homo sapiens
KQIEFGFSCDCIIEDIPYLSLHNHKKNHRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGFVEIQTPKIISAASEGGANVFTVSYFKNNAYLAQSPQLYKQMCICADFEKVFSIGPVFRAEDSNTHRHLTEFVGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKYDTDFYILDKYPLAVRPFYTMPDPRNPKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 799354 - protein, 246 aa, Homo sapiens
MCICADFEKVFSIGPVFRAEDSNTHRHLTEFVGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKYDTDFYILDKYPLAVRPFYTMPDPRNPKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 799355 - protein, 517 aa, Homo sapiens
PGSRDSRSSRDLSGAAPPRGVRARVLRPQGREGGDWEGGRSPFGLPYGSLRGRVVSTAQFRVPMPSASASRKSQEKPREIMDAAEDYAKERYGISSMIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGFVEIQTPKIISAASEGGANVFTVSYFKNNAYLAQSPQLYKQMCICADFEKVFSIGPVFRAEDSNTHRHLTEFVGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKYDTDFYILDKYPLAVRPFYTMPDPRNPKQSNSYDMFMRGEEILSGAQRIHDPQLLTERALHHGIDLGKKLA

SEQ ID NO: 799356 - protein, 383 aa, Homo sapiens
PGSRDSRSSRDLSGAAPPRGVRARVLRPQGREGGDWEGGRSPFGLPYGSLRGRVVSTAQFRVPMPSASASRKSQEKPREIMDAAEDYAKERYGISSMIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGFVEIQTPKIISAASEGGANVFTVSYFKNNAYLAQSPQLYKQMCICADFEKVFSIGPVFRAEDSNTHRHLTEFVGLDIEMAFNYHYHEVMEEIADTMVQIFKGLQER

SEQ ID NO: 799357 - protein, 176 aa, Homo sapiens
PGSRDSRSSRDLSGAAPPRGVRARVLRPQGREGGDWEGGRSPFGLPYGSLRGRVVSTAQFRVPMPSASASRKSQEKPREIMDAAEDYAKERYGISSMIQSQEKPDRVLVRVRDLTIQKADEVVWVRARVHTSRAKGRIGFIIKALSVRTPNFLSYIFLTDQSKSLKTKQKHVTFLS

SEQ ID NO: 799358 - protein, 146 aa, Homo sapiens
PGSRDSRSSRDLSGAAPPRGVRARVLRPQGREGGDWEGGRSPFGLPYGSLRGRVVSTAQFRVPMPSASASRKSQEKPREIMDAAEDYAKERYGISSMIQSQEKPDLVCLGLELANYNVMKLFGLAKGLYNERMDSSYAYSITDSLA

SEQ ID NO: 799359 - protein, 70 aa, Homo sapiens
LFIGTSLFIGTSLFIGTQRIHDPQLLTERALHHGIDLEKIKAYIDSFRFGALMNSEVPMNSEVPMNSECR

SEQ ID NO: 799360 - protein, 564 aa, Homo sapiens; identical to SEQ ID NO: 799344

SEQ ID NO: 799361 - protein, 564 aa, Homo sapiens; identical to SEQ ID NO: 799344

SEQ ID NO: 799362 - protein, 564 aa, Homo sapiens; identical to SEQ ID NO: 799344

SEQ ID NO: 799363 - protein, 468 aa, Homo sapiens; identical to SEQ ID NO: 799351

SEQ ID NO: 799364 - protein, 401 aa, Homo sapiens
YQDTAIHINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGFVEIQTPKIISAASEGGANVFTVSYFKNNAYLAQSPQLYKQMCICADFEKVFSIGPVFRAEDSNTHRHLTEFVGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKYDTDFYILDKYPLAVRPFYTMPDPRNPKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 799365 - protein, 537 aa, Homo sapiens
PGSRDSRSSRDLSGAAPPRGVRARVLRPQGREGGDWEGGRSPFGLPYGSLRGRVVSTAQFRVPMPSASASRKSQEKPREIMDAAEDYAKERYGISSMIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGFVEIQTPKIISAASEGGANVFTVSYFKNNAYLAQSPQLYKQMCICADFEKVFSIGPVFRAEDSNTHRHLTEFVGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 799366 - protein, 559 aa, Homo sapiens
PGSRDSRSSRDLSGAAPPRGVRARVLRPQGREGGDWEGGRSPFGLPYGSLRGRVVSTAQFRVPMPSASASRKSQEKPREIMDAAEDYAKERYGISSMIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGFVEIQTPKIISAASEGGANVFTVSYFKNNAYLAQSPQLYKQMCICADFEKVFSIGPVFRAEDSNTHRHLTEFVGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKYDTDFYILDKYPLAVRPFYTMPDPRNPKQSNSYDMFMRGEEILSGAQRIHDPQLLTERALHHGIDLEKIKAYIDSFRFGAPPHAGGGIGNILLLLTNKFISSKYNTNLNYKNF

SEQ ID NO: 799367 - protein, 148 aa, Homo sapiens
KRRPKSTTTFTNFRPYTPNEKLLGHLVKEKYDTDFYILDKYPLAVRPFYTMPDPRNPKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 799368 - protein, 253 aa, Homo sapiens
PGSRDSRSSRDLSGAAPPRGVRARVLRPQGREGGDWEGGRSPFGLPYGSLRGRVVSTAQFRVPMPSASASRKSQEKPREIMDAAEDYAKERYGISSMIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEEVKIILMKYYASAVYLVCKTLKT

SEQ ID NO: 799369 - protein, 115 aa, Homo sapiens
MLLVGCKSDLRTDVSTLVELSNHRQTPVSYDQGANMAKQIGAATYIECSALQSENSVRDIFHVATLACVNKTNKNVKRNKSQRATKRISHMPSRPELSAVATDLRKDKAKSCTVM

SEQ ID NO: 799370 - protein, 115 aa, Homo sapiens; identical to SEQ ID NO: 799369

SEQ ID NO: 799371 - protein, 115 aa, Homo sapiens; identical to SEQ ID NO: 799369

SEQ ID NO: 799372 - protein, 503 aa, Homo sapiens
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSLHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSGSNRRERGAPPLPPIPR

SEQ ID NO: 799373 - protein, 503 aa, Homo sapiens; identical to SEQ ID NO: 799372

SEQ ID NO: 799374 - protein, 503 aa, Homo sapiens; identical to SEQ ID NO: 799372

SEQ ID NO: 799375 - protein, 503 aa, Homo sapiens; identical to SEQ ID NO: 799372

SEQ ID NO: 799376 - protein, 495 aa, Homo sapiens
MTEVHQYWTNLKEAGAGGGGGRLLQFLLLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSLHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSGSNRRERGAPPLPPIPR

SEQ ID NO: 799377 - protein, 454 aa, Homo sapiens
HEANPLHHLLQWATGPPSTGKRFPLLLLRTTSLQCLPLRGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSLHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSGSNRRERGAPPLPPIPR

SEQ ID NO: 799378 - protein, 503 aa, Homo sapiens; identical to SEQ ID NO: 799372

SEQ ID NO: 799379 - protein, 503 aa, Homo sapiens; identical to SEQ ID NO: 799372

SEQ ID NO: 799380 - protein, 358 aa, Homo sapiens
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSLHNRGSPPVPGGPRQPSPGPTPPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSGSNRRERGAPPLPPIPR

SEQ ID NO: 799381 - protein, 84 aa, Homo sapiens
CAFRYVSLHSTLSVTEDTACFSSQMSGKADSTSIRFPICHLQSHMYKRPKVIPANWQETKAGVSISAKVFEDSRLSSLSDTRAI

SEQ ID NO: 799382 - protein, 343 aa, Homo sapiens
MPVPPPPAPPPPPTFALANTEKPTLNKTEQAGRNALLSDISKGKKLKKTVTNDRSAPILDKPKGAGAGGGEAGSAGRQTDYRPKDSEKAEQQVTTIPKRGTHPSNNSKRYAPQHRKARKPQTPRHQTRELKEYMRRKTEHSKSETTAERRSKLQKNHKTTTRKWNQENRNQMTHTKGKEKYETSKRHTDGNREERTTKSRKKEYTAQQQKKTNDTTHRTNDNPLEQDSKKGDTRKSEQRAQETQSKQKTPQPREQHRRTITAGLQTDPRRENDTRPTEKTRGENEAESTKRKNRPEQSNTHRTTDKHQRQTENEAKKQQETTNQTHNTAQDSTDTTNSSTKNK

SEQ ID NO: 799383 - protein, 503 aa, Homo sapiens; identical to SEQ ID NO: 799372

SEQ ID NO: 799384 - protein, 503 aa, Homo sapiens; identical to SEQ ID NO: 799372

SEQ ID NO: 799385 - protein, 503 aa, Homo sapiens; identical to SEQ ID NO: 799372

SEQ ID NO: 799386 - protein, 493 aa, Homo sapiens [sequence omitted]

SEQ ID NO: 799387 - protein, 403 aa, Homo sapiens
MPVPPPPAPPPPPTFALANTEKPTLNKTEQAGRNALLSDISKGKKLKKTVTNDRSAPILDKPKGAGAGGGGGGFGGGGGFGGGGGGGGGGSFGGGGPPGLGGLFQAGMPKLRSTANRDNDSGGSRPPLLPPGGRSTSAKPFSPPSGPGRFPVPSPGHRSGPPEPQRNRMPPPRPDVGSKPDSIPPPVPSTPRPIQSSLHNRGSPPVPGGPRQPSPGPTPPPFPGNRGTALGGGSIRQSPLSSSSPFSNRPPLPPTPSRALDDKPPPPPPPVGNRPSIHREAVPPPPPQNNKPPVPSTPRPSASSQAPPPPPPPSRPGPPPLPPSSSGNDETPRLPQRNLSLSSSTPPLPSPGRSGPLPPPPSERPPPPVRDPPGRSGMTRRGVSCFQNPACPNVPIILSVKIV

SEQ ID NO: 799388 - protein, 343 aa, Homo sapiens
MPVPPPPAPPPPPTFALANTEKPTLNKTEQAGRNALLSDISKGKKLKKTVTNDRSAPILDKPKGAGAGGGEAGSAGRQTDYRPKDSEKAEQQVTTIPKRGTHPSNNSKRYAPQHRKARKPQTPRHQTRELKEYMRRKTEHSKSETTAERRSKLQKNHKTTTRKWNQENRNQMTHTKGKEKYETSKRHTDGNREERTTKSRKKEETAQQQKKTNDTTHRTNDNPLEQDSKKGDTRKSEQRAQETQSKQKTPQPREQHRRTITAGLQTDPRRENDTRPTEKTRGENEAESTKRKNRPEQSNTHRTTDKHQRQTENEAKKQQETTNQTHNTAQDSTDTTNSSTKNK

SEQ ID NO: 799389 - protein, 125 aa, Homo sapiens
MARYEARCQVAPVRQQGSVAGARAGVVSLLGCRSSWTAAMELSAEYLREKLQRDLEAEHVEVEDTTLNRCSCSFRVLVVSAKFEGKPLLQRHRLVNACLAEELPHIHAFEQKTLTPDQWARERQK

SEQ ID NO: 799390 - protein, 168 aa, Homo sapiens
SSGNNAEYAGSSGNNAEYAGSSGNNAEYAGSSGNNAEYAESSGNNAEYAGPEVAPVRQQGSVAGARAGVVSLLGCRSSWTAAMELSAEYLREKLQRDLEAEHVEVEDTTLNRCSCSFRVLVVSAKFEGKPLLQRHRLVNACLAEELPHIHAFEQKTLTPDQWARERQK

SEQ ID NO: 799391 - protein, 120 aa, Homo sapiens [sequence omitted]

SEQ ID NO: 799392 - protein, 152 aa, Homo sapiens
MASAKSLDRWKARLLEGGSTALTYALVRAEVSFPAEVAPVRQQGSVAGARAGVVSLLGCRSSWTAAMELSAEYLREKLQRDLEAEHVEVEDTTLNRCSCSFRVLVVSAKFEGKPLLQRHRLVNACLAEELPHIHAFEQKTLTPDQWARERQK

SEQ ID NO: 799393 - protein, 152 aa, Homo sapiens; identical to SEQ ID NO: 799392

SEQ ID NO: 799394 - protein, 168 aa, Homo sapiens; identical to SEQ ID NO: 799390

SEQ ID NO: 799395 - protein, 152 aa, Homo sapiens; identical to SEQ ID NO: 799392

SEQ ID NO: 799396 - protein, 152 aa, Homo sapiens; identical to SEQ ID NO: 799392

SEQ ID NO: 799397 - protein, 124 aa, Homo sapiens
MASAKSLDRWKARLLEGGSTALTYALVRAEVSFPAEVAPVRQQGSVAGARAGVVSLLGCRSSWTAAMELSAEYLREKLQRDLEAEHVEVEDTTLNRCSCSFRVLVVSAKFEGKPLLQRHRLLNR

SEQ ID NO: 799398 - protein, 193 aa, Homo sapiens
MASAKSLDRWKARLLEGGSTALTYALVRAEVSFPAEVAPVRQQGSVAGARAGVVSLLGCRSSWTAAMELSAEYLREKLQRDLEAEHVEVEDTTLNRCSCSFRVLVVSAKFEGKPLLQRHRETVSRRVAQAGLKLLGSNDPAASASHSAGIIDVSPHAQPPSLFLSLDLQFKRCLPCSVQSNEMCDGCKPGVFF

SEQ ID NO: 799399 - protein, 287 aa, Homo sapiens
MASAKSLDRWKARLLEGGSTALTYALVRAEVSFPAEVAPVRQQGSVAGARAGVVSLLGCRSSWTAAMELSAEYLREKLQRDLEAEHVEVEDTTLNRCSCSFRVLVVSAKFEGKPLLQRHSLDPSMTIHCDMVITYGLDQLENCQTCGTDYIISVLNLLTLIVEQINTKLPSSFVEKLFIPSSKLLFLRYHKEKEVVAVAHAVYQAMLSLKNIPVLETAYKLILGEMTCALNNLLHSLQLPEACSEIKHEAFKNHVFNVDNAKFVVKFDLSALTTIGNAKNSLIGVSL

SEQ ID NO: 799400 - protein, 386 aa, Homo sapiens
MASAKSLDRWKARLLEGGSTALTYALVRAEVSFPAEVAPVRQQGSVAGARAGVVSLLGCRSSWTAAMELSAEYLREKLQRDLEAEHVEVEDTTLNRCSCSFRVLVVSAKFEGKPLLQRHRLECNGTISAHHNLRLLGSSDSLVSASQVAGITETVSRRVAQAGLKLLGSNDPAASASHSAGIIDVLYRVMRCVTAANQVFFSEAVLTAANECVGVLLGSLDPSMTIHCDMVITYGLDQLENCQTCGTDYIISVLNLLTLIVEQINTKLPSSFVEKLFIPSSKLLFLRYHKEKEVVAVAHAVYQAMLSLKNIPVLETAYKLILGEMTCALNNLLHSLQLPEACSEIKHEAFKNHVFNVDNAKFVVKFDLSALTTIGNAKNSLIGVSL

SEQ ID NO: 799401 - protein, 124 aa, Homo sapiens
MASAKSLDRWKARLLEGGSTALTYALVRAEVSFPAEVAPVRQQGSVAGARAGVVSLLGCRSSWTAAMELSAEYLREKLQRDLEAEHVEVEDTTLNRCSCSFRVLVVSAKFEGKPLLQRHRFCTE

SEQ ID NO: 799402 - protein, 120 aa, Homo sapiens [sequence omitted]

SEQ ID NO: 799403 - protein, 115 aa, Homo sapiens
MASAKSLDRWKARLLEGGSTALTYALVRAEVSFPAEVAPVRQQGSVAGARAGVVSLLGCRSSWTAAMELSAEYLREKLQRDLEAEHVLPSPGGVGQVRGETAASETQVRPWEHLA

SEQ ID NO: 799404 - protein, 111 aa, Homo sapiens
MASAKSLDRWKARLLEGGSTALTYALVRAEVSFPAEVAPVRQQGSVAGARAGVVSLLGCRSSWTAAMELSAEYLREKLQRDLEAEHVELSRRTRGKELGGRVRHHSYSSAR

SEQ ID NO: 799405 - protein, 227 aa, Homo sapiens
MASAKSLDRWKARLLEGGSTALTYALVRAEVSFPAEVAPVRQQGSVAGARAGVVSLLGCRSSWTAAMELSAEYLREKLQRDLEAEHVLPSPGGVGQVRGETAASETQAGVQWHDLGSPQPPPPGFKRFSCLSLPSSWDYRYVLPRPANLVFLIETGFLHVVQAGLELPTSGDPPASASKSAGITGVCHLCPAFFFVFFPHLYCPSSFLWHTEEVGPGNDAMGGPCLI

SEQ ID NO: 799406 - protein, 123 aa, Homo sapiens
MASAKSLDRWKARLLEGGSTALTYALVRAEVSFPAEVAPVRQQGSVAGARAGVVSLLGCRSSWTAAMELSAEYLREKLQRDLEAEHVLPSPGGVGQVRGETAASETQAGERVPSRRAPAHPCL

SEQ ID NO: 799407 - protein, 123 aa, Homo sapiens; identical to SEQ ID NO: 799406

SEQ ID NO: 799408 - protein, 163 aa, Homo sapiens
MTIHCDMVITYGLDQLENCQTCGTDYIISVLNLLTLIVEQINTKLPSSFVEKLFIPSSKLLFLRYHKEKEVVAVAHAVYQAMLSLKNIPVLETAYKLILGEMTCALNNLLHSLQLPEACSEIKHEAFKNHVFNVDNAKFVVKFDLSALTTIGNAKNSLIGVSL

SEQ ID NO: 799409 - protein, 272 aa, Homo sapiens
PQQPPQPQPQPPGSSATTPGGGSGGSLSAMPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQDRSRMYDSLNMHSLENSLIDIMRAEHDPLKGR

SEQ ID NO: 799410 - protein, 618 aa, Homo sapiens
PQQPPQPQPQPPGSSATTPGGGSGGSLSAMPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQVRSSLQLPAWGSDSLQDSWCTAAGTSRIDQDRSRMYDSLNMHSLENSLIDIMRAEHDPLKGRLSYPHPGTDNLLMLNGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 799411 - protein, 588 aa, Homo sapiens
PQQPPQPQPQPPGSSATTPGGGSGGSLSAMPPPSPDSENGFYPGLPSSMNPAFFPSFSPVSPHGCTGLSVPTSGGGGGGFGGPFSATAVPPPPPPAMNIPQQQPPPPAAPQQPQSRRSPVSPQLQQQHQAAAAAFLQQRNSYNHHQPLLKQSPWSNHQSSGWGTGSMSWGAMHGRDHRRTGNMGIPGTMNQISPLKKPFSGNVIAPPKFTRSTPSLTPKSWIEDNVFRTDNNSNTLLPLQDRSRMYDSLNMHSLENSLIDIMRAEHDPLKGRLSYPHPGTDNLLMLNGRSSLFPIDDGLLDDGHSDQVGVLNSPTCYSAHQNGERIERFSRKVFVGGLPPDIDEDEITASFRRFGPLVVDWPHKAESKSYFPPKGYAFLLFQEESSVQALIDACIEEDGKLYLCVSSPTIKDKPVQIRPWNLSDSDFVMDGSQPLDPRKTIFVGGVPRPLRAVELAMIMDRLYGGVCYAGIDTDPELKYPKGAGRVAFSNQQSYIAAISARFVQLQHGDIDKRVEVKPYVLDDQMCDECQGARCGGKFAPFFCANVTCLQYYCEFCWANIHSRAGREFHKPLVKEGADRPRQIHFRWN

SEQ ID NO: 799412 - protein, 72 aa, Homo sapiens
GSSVYSWPVGFTFALLMMVQSASVSKAGKGSSSSHGVAAALNQDLDPDPKCHVFNVSSQRCQMGSAQPCLCC

SEQ ID NO: 799413 - protein, 72 aa, Homo sapiens; identical to SEQ ID NO: 799412

SEQ ID NO: 799414 - protein, 115 aa, Homo sapiens
APEAAVVAQQAEGGSSVEPVPSRGEAGSPRYTVFKLTDIFLCLTIVLLRASSKFFRLTDQGCSCYYRRCVAPYLSKAINAEWPWYGRRSAAWLEDMATPVGVEHGEQSQAFSDDD

SEQ ID NO: 799415 - protein, 115 aa, Homo sapiens; identical to SEQ ID NO: 799414

SEQ ID NO: 799416 - protein, 108 aa, Homo sapiens
MQLLLPEVCGTLPQQGYETQSGHGTAGGRPRGWKTWPLQSVLSTASSLRPLVMMVQSASVSKAGKGSSSSHGVAAALNQDLDPDPKCHVFNVSSQRCQMGSAQPCLCC

SEQ ID NO: 799417 - protein, 115 aa, Homo sapiens; identical to SEQ ID NO: 799414

SEQ ID NO: 799418 - protein, 115 aa, Homo sapiens; identical to SEQ ID NO: 799414

SEQ ID NO: 799419 - protein, 115 aa, Homo sapiens; identical to SEQ ID NO: 799414

SEQ ID NO: 799420 - protein, 108 aa, Homo sapiens
MQLLLPEVCGTLPQQGYETQSGHGTAGGRPRGWKTWPLQSVLSTASSLRPLVMMVRLPGWENGVFLDTTLTYLASLPQRRSGDDNLGFSLIGWLGGLKVLDEKMLSKR

SEQ ID NO: 799421 - protein, 72 aa, Homo sapiens
GAAAAAGAGSQRLPRRRPRCLPLLSCALFSCNCAECWLVLWDVDAVLPCTDGSQPAGKPLRLLPEGAGLRCG

SEQ ID NO: 799422 - protein, 115 aa, Homo sapiens; identical to SEQ ID NO: 799414

SEQ ID NO: 799423 - protein, 115 aa, Homo sapiens; identical to SEQ ID NO: 799414

SEQ ID NO: 799424 - protein, 115 aa, Homo sapiens; identical to SEQ ID NO: 799414

SEQ ID NO: 799425 - protein, 108 aa, Homo sapiens; identical to SEQ ID NO: 799416

SEQ ID NO: 799426 - protein, 115 aa, Homo sapiens; identical to SEQ ID NO: 799414

SEQ ID NO: 799427 - protein, 115 aa, Homo sapiens; identical to SEQ ID NO: 799414

SEQ ID NO: 799428 - protein, 108 aa, Homo sapiens; identical to SEQ ID NO: 799416

SEQ ID NO: 799429 - protein, 108 aa, Homo sapiens; identical to SEQ ID NO: 799420

SEQ ID NO: 799430 - protein, 115 aa, Homo sapiens; identical to SEQ ID NO: 799414

SEQ ID NO: 799431 - protein, 115 aa, Homo sapiens; identical to SEQ ID NO: 799414

SEQ ID NO: 799432 - protein, 115 aa, Homo sapiens; identical to SEQ ID NO: 799414

SEQ ID NO: 799433 - protein, 115 aa, Homo sapiens; identical to SEQ ID NO: 799414

SEQ ID NO: 799434 - protein, 145 aa, Homo sapiens
APEAAVVAQQAEGGSSVEPVPSRGEAGSPRYTVFKLTDIFLCLTIVLLRASSKFFRLTDQGCSCYYRRCVAPYLSKAINAEWPWYGRRSAAWLEDMATPVGVEHGEQSQAFSDDFSRDWVSPCWPGWSLSPDLVICLPQLPKVLR

SEQ ID NO: 799435 - protein, 115 aa, Homo sapiens; identical to SEQ ID NO: 799414

SEQ ID NO: 799436 - protein, 108 aa, Homo sapiens; identical to SEQ ID NO: 799416

SEQ ID NO: 799437 - protein, 108 aa, Homo sapiens; identical to SEQ ID NO: 799416

SEQ ID NO: 799438 - protein, 108 aa, Homo sapiens; identical to SEQ ID NO: 799416

SEQ ID NO: 799439 - protein, 342 aa, Homo sapiens
MDILKSEILRKRQLVEDRNLLVENKKYFKRSELAKKEEEAYFERCGYKIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDHKDMDIITKFLKFLLGVWAKELNAREDYVKRSVQGKLNSATQKQTESYLRPLFRKLRKRNLPADIKESITDIIKFMLQREYVKANDAYLQMAIGNAPWPIGVTMVGIHARTGREKIFSKHVAHVLNDETQRKYIQGLKRLMTICQKHFPTDPSKCVEYNAL

SEQ ID NO: 799440 - protein, 120 aa, Homo sapiens
MMLIFRWPLEMRLGPSVSLCEVDTKLTITAAFLWASCYMRTVLGVHLKRSGNMNPFCTLESPVQPCMELGKAGPELSRETWWRKPRPALSLPGPGQVCVCPSSTLGGLQAAAEGIPWALC

SEQ ID NO: 799441 - protein, 86 aa, Homo sapiens
LSHPSFRRKRLLSVVLRCLGLLFRILSGFAAAGPVRLGSRSWSGKLELKFWRRDGHSEIRDPSEAAAGGGQEPAGGEDPAVVGVGM

SEQ ID NO: 799442 - protein, 342 aa, Homo sapiens; identical to SEQ ID NO: 799439

SEQ ID NO: 799443 - protein, 342 aa, Homo sapiens; identical to SEQ ID NO: 799439

SEQ ID NO: 799444 - protein, 295 aa, Homo sapiens
MDILKSEILRKRQLVEDRNLLVENKKYFKRSELAKKEEEAYFERCGYKIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDHKDMDIITKFLKNLPADIKESITDIIKFMLQREYVKANDAYLQMAIGNAPWPIGVTMVGIHARTGREKIFSKHVAHVLNDETQRKYIQGLKRLMTICQKHFPTDPSKCVEYNAL

SEQ ID NO: 799445 - protein, 285 aa, Homo sapiens
MDILKSEILRKRQLVEDRNLLVENKKYFKRSELAKKEEEAYFERCGYKIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDHKDMDIITKFLKFLLGVWAKELNAREDYVKRSVQGKLNSATQKQTESYLRPLFRKLRKRNLPADIKESITDIIKFMLQREYVKANDAYLQMAIGNAPWPIGVTM

SEQ ID NO: 799446 - protein, 327 aa, Homo sapiens
MIRTFPGENKKYFKRSELAKKEEEAYFERCGYKIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDHKDMDIITKFLKFLLGVWAKELNAREDYVKRSVQGKLNSATQKQTESYLRPLFRKLRKRNLPADIKESITDIIKFMLQREYVKANDAYLQMAIGNAPWPIGVTMVGIHARTGREKIFSKHVAHVLNDETQRKYIQGLKRLMTICQKHFPTDPSKCVEYNAL

SEQ ID NO: 799447 - protein, 336 aa, Homo sapiens
MIRTFPGENKKYFKRSELAKKEEEAYFERCGYKPINEKPSGEIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDHKDMDIITKFLKFLLGVWAKELNAREDYVKRSVQGKLNSATQKQTESYLRPLFRKLRKRNLPADIKESITDIIKFMLQREYVKANDAYLQMAIGNAPWPIGVTMVGIHARTGREKIFSKHVAHVLNDETQRKYIQGLKRLMTICQKHFPTDPSKCVEYNAL

SEQ ID NO: 799448 - protein, 324 aa, Homo sapiens
MDILKSEILRKRQLVEDRNLLVENKKYFKRSELAKKEEEAYFERCGYKIQPKEEDQKPLTSSNPVLELELAEEKLPMTLSRQEVIRRLRERGEPIRLFGETDYDAFQRLRTALDKIDQQYLNEIVGGQEPGEEDTQNDLKVHEENTTIEELEALGESLGKGDDHKDMDIITKFLKFLLGVWAKELNAREDYVKRSVQGKLNSATQKQTESYLRPLFRKLRKRNLPADIKESITDIIKFMLQREYVKANDAYLQMAIGNAPWPIGVTMVGIHARTGREKIFSKHVAHVLNDETQRKYIQGLKRLMTICQKHFPTDPSKCVEYNAL

SEQ ID NO: 799449 - protein, 285 aa, Homo sapiens; identical to SEQ ID NO: 799445

SEQ ID NO: 799450 - protein, 285 aa, Homo sapiens; identical to SEQ ID NO: 799445

SEQ ID NO: 799451 - protein, 295 aa, Homo sapiens; identical to SEQ ID NO: 799444

SEQ ID NO: 799452 - protein, 245 aa, Homo sapiens
MDILKSEILRKRQLVEDRNLLVENKKYFKRSELAKKEEEAYFERCGYKIQPKEEDQKPLTSSNPVLELELAEEKLPMTLSRQEVIRRLRERGEPIRLFGETDYDAFQRLRKIEILTPEVNKGLRNDLKAALDKIDQQYLNEIVGGQEPGEEDTQNDLKVHEENTTIEELEALGESLGKGDDHKDMDIITKFLKFLLGVWAKELNAREDYVKRSVQGKLNSATQKQTESYLRPLFRKLRKRNLPAD

SEQ ID NO: 799453 - protein, 308 aa, Homo sapiens
MCRVPVFEWLSRKRGTVLLPVAAAPGHLQLVKKAYRQKALSCHPDKNPDNPRAAELFHQLSQALEVLTDAAARAAYDKVRKAKKQAAERTQKLDEKRKKVKLDLEARERQAQAQESEEEEESRSTRTLEQEIERLREEGSRQLEEQQRLIREQIRQERDQRLRGKAENTEGQGTPKLKLKWKCKKEDESKGGYSKDVLLRLLQKYGEVLNLVLSSKKPGTAVVEFATVKAAELAVQNEVGLVDNPLKISWLEGQPQDAVGRSHSGLSKGSVLSERDYESLVMMRMRQAAERQQLIARMQQEDQEGPPT

SEQ ID NO: 799454 - protein, 329 aa, Homo sapiens
MCRVPVFEWLSRKRGTVLLPVAAAPGHLQLVKKAYRQKALSCHPDKNPDNPRAAELFHQLSQALEVLTDAAARAAYDKVRKAKKQAAERTQKLDEKRKKVKLDLEARERQAQAQESEEEEESRSTRTLEQEIERLREEGSRQLEEQQRLIREQIRQERDQRLRGKAENTEGQGTPKLKLKWKCKKEDESKGGYSKDVLLRLLQKVGPVDVHSFLSSQSTSQSTPYYGEVLNLVLSSKKPGTAVVEFATVKAAELAVQNEVGLVDNPLKISWLEGQPQDAVGRSHSGLSKGSVLSERDYESLVMMRMRQAAERQQLIARMQQEDQEGPPT

SEQ ID NO: 799455 - protein, 304 aa, Homo sapiens
MAVTKELLQMDLYALLGIEEKAADKEVKKAYRQKALSCHPDKNPDNPRAAELFHQLSQALEVLTDAAARAAYDKVRKAKKQAAERTQKLDEKRKKVKLDLEARERQAQAQESEEEEESRSTRTLEQEIERLREEGSRQLEEQQRLIREQIRQERDQRLRGKAENTEGQGTPKLKLKWKCKKEDESKGGYSKDVLLRLLQKYGEVLNLVLSSKKPGTAVVEFATVKAAELAVQNEVGLVDNPLKISWLEGQPQDAVGRSHSGLSKGSVLSERDYESLVMMRMRQAAERQQLIARMQQEDQEGPPT

SEQ ID NO: 799456 - protein, 304 aa, Homo sapiens; identical to SEQ ID NO: 799455

SEQ ID NO: 799457 - protein, 493 aa, Homo sapiens
MHTLVFLSTRQVLQCQPAACQALPLLPRELFPLLFKVAFMDKKTVVLRELVHTWPFPLLSFQQLLQECAHCSRALLQERPSTESMQAVILGLTARLHTSEPGASTQPLCRKHALRVLDMTGLLDDGVEQDPGTMSMWDCTAAVARTCIAQQQGGAAEPGPAPIPVEVRVDLRVNRASYAFLREALRSSVGSPLRLCCRDLRAEDLPMRNTVALLQLLDAGCLRRVDLRFNNLGLRGLSVIIPHVARFQHLASLRLHYVHGDSRQPSVDGEDNFRYFLAQMGRFTCLRELSMGSSLLSGRLDQLLSTLQSPLESLELAFCALLPEDLRFLARSPHAAHLKKLDLSGNDLSGSQLAPFQGLLQASAATLLHLELTECQLADTQLLATLPILTQCASLRYLGLYGNPLSMAGLKELLRDSVAQAELRTVVHPFPVDCYEGLPWPPPASVLLEASINEEKFARVEAELHQLLLASGRAHVLWTTDIYGRLAADYFSL

SEQ ID NO: 799458 - protein, 493 aa, Homo sapiens; identical to SEQ ID NO: 799457

SEQ ID NO: 799459 - protein, 531 aa, Homo sapiens
QRHRGAPRRRAGSGGRSRRGWRRWLRLRDRWPSARPSTMHTLVFLSTRQVLQCQPAACQALPLLPRELFPLLFKVAFMDKKTVVLRELVHTWPFPLLSFQQLLQECAHCSRALLQERPSTESMQAVILGLTARLHTSEPGASTQPLCRKHALRVLDMTGLLDDGVEQDPGTMSMWDCTAAVARTCIAQQQGGAAEPGPAPIPVEVRVDLRVNRASYAFLREALRSSVGSPLRLCCRDLRAEDLPMRNTVALLQLLDAGCLRRVDLRFNNLGLRGLSVIIPHVARFQHLASLRLHYVHGDSRQPSVDGEDNFRYFLAQMGRFTCLRELSMGSSLLSGRLDQLLSTLQSPLESLELAFCALLPEDLRFLARSPHAAHLKKLDLSGNDLSGSQLAPFQGLLQASAATLLHLELTECQLADTQLLATLPILTQCASLRYLGLYGNPLSMAGLKELLRDSVAQAELRTVVHPFPVDCYEGLPWPPPASVLLEASINEEKFARVEAELHQLLLASGRAHVLWTTDIYGRLAADYFSL

SEQ ID NO: 799460 - protein, 493 aa, Homo sapiens; identical to SEQ ID NO: 799457

SEQ ID NO: 799461 - protein, 493 aa, Homo sapiens; identical to SEQ ID NO: 799457

SEQ ID NO: 799462 - protein, 493 aa, Homo sapiens; identical to SEQ ID NO: 799457

SEQ ID NO: 799463 - protein, 493 aa, Homo sapiens; identical to SEQ ID NO: 799457

SEQ ID NO: 799464 - protein, 493 aa, Homo sapiens; identical to SEQ ID NO: 799457

SEQ ID NO: 799465 - protein, 497 aa, Homo sapiens
MHTLVFLSTRQVLQCQPAACQALPLLPRELFPLLFKVAFMDKKTVVLRELVHTWPFPLLSFQQLLQECAHCSRALLQERPSTESMQAVILGLTARLHTSEPGASTQPLCRKHALRVLDMTGLLDDGVEQDPGTMSMWDCTAAVARTCIAQQQGGAAEPGPAPIPVEVRVDLRVNRASYAFLREALRSSVGSPLRLCCRDLRAEDLPMRNTVALLQLLDAGCLRRVDLRFNNLGLRGLSVIIPHVARFQHLASLRPQALTPLTCSLPCHPATPLGWARAGGGHQGTHVPGSLNLWLFFFLSTLVTLILISAVTPNMATGQQLPSSLSPRPSRGSPVGTAGQSLLFPPFGGPRSYCGRPGPARDPPHAELEVGVMSFRKSFKGGVGASPATFHCYPRIPECNVPGSLPHTRLSAHCAASTFTDGACARPHRPISGAHVIRAPAALAVDLVGDRRGHAESRPRPLFRAAVSGRLRRTLGEERLGAVDDEHLVAALVAELL

SEQ ID NO: 799466 - protein, 127 aa, Homo sapiens
GTLAWGKQKTGTPRGRVPELYSPAHPLPQPSSVAAGGGAAFQTAAQLPDVRAPPHMSLLPTANTVAQTETLSEEEVPVRRRTCRLARGCRASRLMVPSWFLLRSSSAREDSPARAWSSSSSMLFSCR

SEQ ID NO: 799467 - protein, 515 aa, Homo sapiens
SPCARAPASRLGSSMQARYSVSDPNALGVVPYLSEQNYYRAAGSYGGMASPMGVYSGHPEQYSAGMGRSYAPYHHHQPAAPKDLVKPPYSYIALITMAIQNAPEKKITLNGIYQFIMDRFPFYRENKQGWQNSIRHNLSLNECFVKVPRDDKKPGKGSYWTLDPDSYNMFENGSFLRRRRRFKKKDVSKEKEERAHLKEPPPAASKGAPATPHLADAPKEAEKKVVIKSEAASPALPVITKVETLSPESALQGSPRSAASTPAGSPDGSLPEHHAAAPNGLPGFSVENIMTLRTSPPGGELSPGAGRAGLVVPPLALPYAAAPPAAYGQPCAQGLEAGAAGGYQCSMRAMSLYTGAERPAHMCVPPALDEALSDHPSGPTSPLSALNLAAGQEGALAATGHHHQHHGHHHPQAPPPPPAPQPQPTPQPGAAAAQAASWYLNHSGDLNHLPGHTFAAQQQTFPNVREMFNSHRLGIENSTLGESQVSGNASCQLPYRSTPPLYRHAAPYSYDCTKY

SEQ ID NO: 799468 - protein, 453 aa, Homo sapiens
DAEIRTRSSPSAIFAAAATAVAAPPPPRAARKPPQTGGARARPPPGLSPPPAALPFRTTVAALGGKAPAAGSRGAGPEREPGWGGRALRVRRGAAGEARGGWSWRRGAGELRTMCAQYCISFADVEKAHINIRDSIHLTPVLTSSILNQLTGRNLFFKCELFQKTGSFKIRGALNAVRSLVPDALERKPKAVVTHSSGNHGQALTYAAKLEGIPAYIVVPQTAPDCKKLAIQAYGASIVYCEPSDESRENVAKRVTEETEGIMVHPNQEPAVIAGQGTIALEVLNQVPLVDALVVPVGGGGMLAGIAITVKALKPSVKVYAAEPSNADDCYQSKLKGKLMPNLYPPETIADGVKSSIGLNTWPIIRDLVDDIFTVTEDEIKCATQLVWERMKLLIEPTAGVGVAAVLSQHFQTVSPEVKNICIVLSGGNVDLTSSITWVKQAERPASYQSVSV

SEQ ID NO: 799469 - protein, 288 aa, Homo sapiens
DAEIRTRSSPSAIFAAAATAVAAPPPPRAARKPPQTGGARARPPPGLSPPPAALPFRTTVAALGGKAPAAGSRGAGPEREPGWGGRALRVRRGAAGEARGGWSWRRGAGELRTMCAQYCISFADVEKAHINIRDSIHLTPVLTSSILNQLTGRNLFFKCELFQKTGSFKIRGALNAVRSLVPDALERKPKAVVTHSSGNHGQALTYAAKLEGIPAYIVVPQTAPDCKKLAIQAYGASIVYCEPSDESRENVAKRVTEETEGIMVHPNQEPAVIAGQGTIALEVLNQVK

SEQ ID NO: 799470 - protein, 288 aa, Homo sapiens; identical to SEQ ID NO: 799469

SEQ ID NO: 799471 - protein, 253 aa, Homo sapiens
DAEIRTRSSPSAIFAAAATAVAAPPPPRAARKPPQTGGARARPPPGLSPPPAALPFRTTVAALGGKAPAAGSRGAGPEREPGWGGRALRVRRGAAGEARGGWSWRRGAGELRTMCAQYCISFADVEKAHINIRDSIHLTPVLTSSILNQLTGRNLFFKCELFQKTGSFKIRGALNAVRSLVPDALERKPKAVVTHSSGNHGQALTYAAKLEGIPAYIVVPQTAPDCKKLAIQAYGASIVYCEPSDEIPTRSLQ

SEQ ID NO: 799472 - protein, 172 aa, Homo sapiens
MVSLSATDCYIVHEIYNGENAQDQFEYELEQALEAQYKYIVIEPTRIGDETARWITVGNCLHKTAVLAGTACLFTPLALPLDYSHYISLPAGVLSLACCTLYGISWQFDPCCKYQVEYDAYKLSRLPLHTLTSSTPVVLVRKDDLHRKRLHNTIALAALVYCVKKIYELYAV

SEQ ID NO: 799473 - protein, 191 aa, Homo sapiens
RECVYVPRGSTWLCSCPEERVSLSATDCYIVHEIYNGENAQDQFEYELEQALEAQYKYIVIEPTRIGDETARWITVGNCLHKTAVLAGTACLFTPLALPLDYSHYISLPAGVLSLACCTLYGISWQFDPCCKYQVEYDAYKLSRLPLHTLTSSTPVVLVRKDDLHRKRLHNTIALAALVYCVKKIYELYAV

SEQ ID NO: 799474 - protein, 144 aa, Homo sapiens
MVSLSATDCYIVHEIYNGENAQDQFEYELEQALEAQYKYIVIEPTRIGDETARWITVGNCLHKTAVLAGTACLFTPLALPLDYSHYISLPAGVLSLACCTLYGISWQFDPCCKYQVEYDAYKLSRLPLHTLNSVRQQSLGRCLA

SEQ ID NO: 799475 - protein, 349 aa, Homo sapiens
AEGPGASSPQTARRPPAGEAAWRPGQRGRAPPRGALGVVGTCLSSLLQLLALETQGPTGGWAPVTPRLRTPGTQFLQKCSNQDGSWSPRALAEGLRAPATPGAGLPARCLVGTVVPPGLASACRAAPDRRPDYTSRRPACSPDAALARDVGKQSVSKMAAWGRRRLGPGSSGGSARERVSLSATDCYIVHEIYNGENAQDQFEYELEQALEAQYKYIVIEPTRIGDETARWITVGNCLHKTAVLAGTACLFTPLALPLDYSHYISLPAGVLSLACCTLYGISWQFDPCCKYQVEYDAYKLSRLPLHTLTSSTPVVLVRKDDLHRKRLHNTIALAALVYCVKKIYELYAV

SEQ ID NO: 799476 - protein, 349 aa, Homo sapiens; identical to SEQ ID NO: 799475

SEQ ID NO: 799477 - protein, 198 aa, Homo sapiens
MDTEKVLEQEVSHLPLFLAVEGGPAHGVSLSATDCYIVHEIYNGENAQDQFEYELEQALEAQYKYIVIEPTRIGDETARWITVGNCLHKTAVLAGTACLFTPLALPLDYSHYISLPAGVLSLACCTLYGISWQFDPCCKYQVEYDAYKLSRLPLHTLTSSTPVVLVRKDDLHRKRLHNTIALAALVYCVKKIYELYAV

SEQ ID NO: 799478 - protein, 181 aa, Homo sapiens
EIIILMVNSLVSLSATDCYIVHEIYNGENAQDQFEYELEQALEAQYKYIVIEPTRIGDETARWITVGNCLHKTAVLAGTACLFTPLALPLDYSHYISLPAGVLSLACCTLYGISWQFDPCCKYQVEYDAYKLSRLPLHTLTSSTPVVLVRKDDLHRKRLHNTIALAALVYCVKKIYELYAV

SEQ ID NO: 799479 - protein, 147 aa, Homo sapiens
MVSLSATDCYIVHEIYNGENAQDQFEYELEQALEAQYKYIVIEPTRIGDETARWITVGNCLHKTAVLAGTACLFTPLALPLDYSHYISLPAGVLSLACCTLYGISWQFDPCCKYQVEYDAYKLSRLPLHTLTPGPQETTEYSDRHTL

SEQ ID NO: 799480 - protein, 98 aa, Homo sapiens
MPPPSKGVSLSATDCYIVHEIYNGENAQDQFEYELEQALEAQYKYIVIEPTRIGDETARWITVGNCLHKTAVLAGTACLFTPLALPLDYSHYISLPAG

SEQ ID NO: 799481 - protein, 695 aa, Homo sapiens
MSILHCYKGIPEVVVAYKEKRVIWLTVVQVVQKHGTSIASCEASGSFHLWWKGKGEFVTYMAREGARAMSGSSKQPALMETNRVRTHSLPRGGHQAIHEGPAPMSQNISHQATPSTLGVTFSMRFGGDHHASKPYQGPIFGEGTRNISLPLSSTSFNVEFSKESRAWVKLKPGLNFLVQLLAVYPWASHLTPSGYNVTNDHIFLNLKNGIGTCPKQSWSDGAINGPAVPGHTVGLGSPDFYRTGSCLQSLFSIVGLAGNCRHPRGQGLMRMPNPSSKWRPQDSITASGGEWLLQQEGFIGMNPFKLQSKCPEWFCRYGCEAGMVVPSAVPWDEALYGRGPGWREEKDGDEPRTTDGPVPWMIFIEVPSSQFNTGLLNLLRYAGKSHLRQWGMLLLKCRLRLSRSRVGPEILCSYQGSILGMEVRYPLTSPVDPAFEGSGEECSVPAATTLKSPRNKDYYRWRGRGPRQTGRWGTPVGLQWALRKACWRWGPKEFKDLFQEPKERVGSNCCSIWEMPGGAGCGRPSQSIRQLVVDEDAVSMARRNSRGCSGQGCQKHEEGQHSVSSGKGKVMVLKLPHVASPFLGSLNKSISCALCGKPTPLQSTSELNRILHFLEAWLDADILQPQGRPKDLQVLRHLEHLHLRPLYMISLLEGFWTMLCVFSPKTWASARLQFKFSEEVPCTPPSAKFSLCKFP

SEQ ID NO: 799482 - protein, 94 aa, Homo sapiens
GVNRDSDLPKVTKAGRAPGCLTVLSKCPHTSTPSAAASSRDSWGSQGRPDSWEPWSGLQRPLTPHGTASLLQDFRMPPLGSPKAVGSPGTLPQS

SEQ ID NO: 799483 - protein, 220 aa, Homo sapiens
MAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQ

SEQ ID NO: 799484 - protein, 337 aa, Homo sapiens
GKLRLGTSLVWIGEVKAHTRKPSEVKLRLGCRDDNFSASSAMAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTAYQATSRAGLIAKLAKPGEGLWLTRHKCSTGPTRGGERT

SEQ ID NO: 799485 - protein, 244 aa, Homo sapiens
PKGCTGPEVFWTVKAHTRKPSEVKLRLGCRDDNFSASSAMAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPPGQYPRGSGSGGPYDIPQGCKLLVKGSGAKIPL

SEQ ID NO: 799486 - protein, 334 aa, Homo sapiens
MAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTNADYTTGQVFDLSEKLEQSEAQLGRGSFMLGLETHDRKSEDKLAKATRDSCKTTIEAIHGLMSQVIKDKLFNQINIS

SEQ ID NO: 799487 - protein, 334 aa, Homo sapiens; identical to SEQ ID NO: 799486

SEQ ID NO: 799488 - protein, 334 aa, Homo sapiens; identical to SEQ ID NO: 799486

SEQ ID NO: 799489 - protein, 334 aa, Homo sapiens; identical to SEQ ID NO: 799486

SEQ ID NO: 799490 - protein, 258 aa, Homo sapiens
MAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTL

SEQ ID NO: 799491 - protein, 334 aa, Homo sapiens; identical to SEQ ID NO: 799486

SEQ ID NO: 799492 - protein, 270 aa, Homo sapiens
MVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTNADYTTGQVFDLSEKLEQSEAQLGRGSFMLGLETHDRKSEDKLAKATRDSCKTTIEAIHGLMSQVIKDKLFNQINIS

SEQ ID NO: 799493 - protein, 379 aa, Homo sapiens
MVSTNFTSGSRCHGCPKSLETTTSPLPRRWRRPGAVWPRKPGNWPTTCRKLRVSMKSTNTTRNSSKKSWRRSPGLRIKGEAKISIHVLTSNMSHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTNADYTTGQVFDLSEKLEQSEAQLGRGSFMLGLETHDRKSEDKLAKATRDSCKTTIEAIHGLMSQVIKDKLFNQINIS

SEQ ID NO: 799494 - protein, 297 aa, Homo sapiens
LQQLQLQQLQLQQLQLQQLQLQQLLLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTNADYTTGQVFDLSEKLEQSEAQLGRGSFMLGLETHDRKSEDKLAKATRDSCKTTIEAIHGLMSQVIKDKLFNQINIS

SEQ ID NO: 799495 - protein, 176 aa, Homo sapiens
MAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVVTMGKAA

SEQ ID NO: 799496 - protein, 87 aa, Homo sapiens
IHEDINNQEKNADYTTGQVFDLSEKLEQSEAQLGRGSFMLGLETHDRKSEDKLAKATRDSCKTTIEAIHGLMSQVIKDKLFNQINIS

SEQ ID NO: 799497 - protein, 124 aa, Homo sapiens
LEDPQLTLQLLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVVTMGKAA

SEQ ID NO: 799498 - protein, 334 aa, Homo sapiens; identical to SEQ ID NO: 799486

SEQ ID NO: 799499 - protein, 296 aa, Homo sapiens
MAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTAYQATSRAGLIAKLAKPGEGLWLTRHKCSTGPTRGGERT

SEQ ID NO: 799500 - protein, 389 aa, Homo sapiens
PTPRGSHCPCPRSGAANAAPGPSTLNLHHPRPHLATHAPHPRLADSYSGERARVRGDTQCSRGSSRTEEVTAATWSGNSMTDLRAGAPPLRPSPPLALRHTAGHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTNADYTTGQVFDLSEKLEQSEAQLGRGSFMLGLETHDRKSEDKLAKATRDSCKTTIEAIHGLMSQVIKDKLFNQINIS

SEQ ID NO: 799501 - protein, 270 aa, Homo sapiens; identical to SEQ ID NO: 799492

SEQ ID NO: 799502 - protein, 212 aa, Homo sapiens
MLKLVGRLENAIGWYHSHPGYGCWLSGIDVSTQMLNQQFQEPFVAVVIDPTRTISAGKVNLGAFRTYPKGYKPPDEGPSEYQTIPLNKIEDFGVHCKQYYALEVSYFKSSLDRKLLELLWNKYWVNTLSSSSLLTNADYTTGQVFDLSEKLEQSEAQLGRGSFMLGLETHDRKSEDKLAKATRDSCKTTIEAIHGLMSQVIKDKLFNQINIS

SEQ ID NO: 799503 - protein, 203 aa, Homo sapiens
MAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPTRTISAGKVNLGAFRTYPKATTPLTRPVRLI

SEQ ID NO: 799504 - protein, 205 aa, Homo sapiens
MAASGSGMAQKTWELANNMQEAQSIDEIYKYDKKQQQEILAAKPWTKDHHYFKYCKISALALLKMVMHARSGGNLEVMGLMLGKVDGETMIIMDSFALPVEGTETRVNAQAAAYEYMAAYIENAKQVGRLENAIGWYHSHPGYGCWLSGIDVSTQMLNQQFQEPFVAVVIDPPGQYPRGSGSGGPYDIPQGCKLLVKGSGAKIPL

SEQ ID NO: 799505 - protein, 147 aa, Homo sapiens
MEDDEEETTASTLRGKPRPPPVSAQSAFSYIPPRRLDPKEHSYYYRPARTGIISLYDCIFKRRLDYDQKLHRDDREHAKSLGLHVNEEEQERPVGVLTSSVYGKRINQPIEPLNRDFGRANHVQADFYRKNDIPSLKEPGFGHIAPS

SEQ ID NO: 799506 - protein, 269 aa, Homo sapiens
MSSYFVNSFSGRYPNGPDYQLLNYGSGSSLSGSYRDPAAMHTGSYGYNYNGMDLSVNRSSASSSHFGAVGESSRAFPAPAQEPRFRQAASSCSLSSPESLPCTNGDSHGAKPSASSPSDQATSASSSANFTEIDEASASSEPEEAASQLSSPSLARAQPEPMATSTAAPEGQTPQIFPWMRKLHISHDMTGPDGKRARTAYTRYQTLELEKEFHFNRYLTRRRRIEIAHALCLSERQIKIWFQNRRMKWKKDNKLKSMSLATAGSAFQP

SEQ ID NO: 799507 - protein, 224 aa, Homo sapiens [sequence omitted]

SEQ ID NO: 799508 - protein, 109 aa, Homo sapiens
MLAHGYMPTCKHTIVLNRDHHHPHNPSVWRSLGLPQVYSNPTQPDPNSSQRRVPKCPRTLTSGGWVGGGKGQGRAAGCRVCCQRSHSGPSFSIPPPGSPLPRPCPTTFS

SEQ ID NO: 799509 - protein, 128 aa, Homo sapiens
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKVSRIILIILHQ

SEQ ID NO: 799510 - protein, 207 aa, Homo sapiens
MCRLKRQEFVISRAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 799511 - protein, 368 aa, Homo sapiens
MAYSTVQRVALASGLVLALSLLLPKAFLSRGKRQEPPPTPEGKLGRFPPMMHHHQAPSDGQTPGARFQRSHLAEAFAKAKGSGGGAGGGGSGRGLMGQIIPIYGFGIFLYILYILFKLSKGKTTAEDGKCYTAMPGNTHRKITSFELAQLQEKLKETEAAMEKLINRVGPNGERAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 799512 - protein, 207 aa, Homo sapiens; identical to SEQ ID NO: 799510

SEQ ID NO: 799513 - protein, 368 aa, Homo sapiens; identical to SEQ ID NO: 799511

SEQ ID NO: 799514 - protein, 368 aa, Homo sapiens; identical to SEQ ID NO: 799511

SEQ ID NO: 799515 - protein, 251 aa, Homo sapiens
LTSLVPSYAVGGSIPRIIICCNCTFYSSTQTDHSDVYVHCLGVFTTKWLDCLIFLSRAQTVTSDQEKRLLHQLREITRVMKEGKFIDRFSPEKEAEEAPYMEDWEGYPEETYPIYDLSDCIKRRQETILVDYPDPKELSAEEIAERMGMIEEEESDHLGWESLPTDPRAQEDNSVTSCDPKPETCSCCFHEDEDPAVLAENAGFSADSYPEQEETTKEEWSQDFKDEGLGISTDKAYTGSMLRKRNPQGLE

SEQ ID NO: 799516 - protein, 368 aa, Homo sapiens; identical to SEQ ID NO: 799511

SEQ ID NO: 799517 - protein, 326 aa, Homo sapiens
MRTEAQVPALQPPEPGLEGAMGHRTLVLPWVLLTLCVTAGTPEVWVQVRMEATELSSFTIRCGFLGSGSISLVTVSWGGPDGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQASQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

SEQ ID NO: 799518 - protein, 306 aa, Homo sapiens [sequence omitted]

SEQ ID NO: 799519 - protein, 132 aa, Homo sapiens
QGPSSSTSQLPPLRPQSSYLSRLVQDRHPSLLEVEQIGLWGDEEGEMGSPYVSQVGFKLLSSSDPLTSASKNAGIIGVSQCARPTNVWACTRCSGSQNAGPFVRCSFPADKEMEAQGAEVLSQHLLPGVSPP

SEQ ID NO: 799520 - protein, 89 aa, Homo sapiens
QGPSSSTSQLPPLRPQSSYLSRLVQDRHPSLLEVEQIGLWGDEEGEMGSPYVSQVGFKLLSSSDPLTSASKNAGIIGVSQCARPTNVSF

SEQ ID NO: 799521 - protein, 90 aa, Homo sapiens
QGPSSSTSQLPPLRPQSSYLSRLVQDRHPSLLEVEQIGLWGDEEGEMGSPYVSQVGFKLLSSSDPLTSASKNAGIIGVSQCARPTNSIST

SEQ ID NO: 799522 - protein, 128 aa, Homo sapiens
MPAHEDGFTQDAFMMPARQSHQNRKMEDAFCGKIVLFEISKRALQLSSQTEFRSSSHAGVQWRNLGSPQPPPPGFRRFSCLSLLITWDYRHVPPHLASFVFLVEMGFLHVGQAGLELLTSGDPPTSAS

SEQ ID NO: 799523 - protein, 272 aa, Homo sapiens [sequence omitted]

SEQ ID NO: 799524 - protein, 272 aa, Homo sapiens [sequence omitted]

SEQ ID NO: 799525 - protein, 440 aa, Homo sapiens
MEQRGQNAPAASGARKRHGPGPREARGARPGLRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 799526 - protein, 411 aa, Homo sapiens
MEQRGQNAPAASGARKRHGPGPREARGARPGLRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 799527 - protein, 411 aa, Homo sapiens; identical to SEQ ID NO: 799526

SEQ ID NO: 799528 - protein, 411 aa, Homo sapiens; identical to SEQ ID NO: 799526

SEQ ID NO: 799529 - protein, 411 aa, Homo sapiens; identical to SEQ ID NO: 799526

SEQ ID NO: 799530 - protein, 411 aa, Homo sapiens; identical to SEQ ID NO: 799526

SEQ ID NO: 799531 - protein, 241 aa, Homo sapiens
IELGTDYSCHKESGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 799532 - protein, 440 aa, Homo sapiens; identical to SEQ ID NO: 799525

SEQ ID NO: 799533 - protein, 411 aa, Homo sapiens; identical to SEQ ID NO: 799526

SEQ ID NO: 799534 - protein, 411 aa, Homo sapiens; identical to SEQ ID NO: 799526

SEQ ID NO: 799535 - protein, 411 aa, Homo sapiens; identical to SEQ ID NO: 799526

SEQ ID NO: 799536 - protein, 260 aa, Homo sapiens
MCRKCRTGCPRGMVKVGDCTPWSDIECVHKESGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 799537 - protein, 352 aa, Homo sapiens
MEQRGQNAPAASGARKRHGPGPREARGARPGLRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGKWVNKTGRDASVHTLLDALETLGERLAKQKIEDHLLSSGKFMYLEGNADSAMS

SEQ ID NO: 799538 - protein, 425 aa, Homo sapiens
MEQRGQNAPAASGARKRHGPGPREARGARPGLRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLILDALETLGERLAKQKIEDHLLSSGKFMYLEGNADSAMS

SEQ ID NO: 799539 - protein, 294 aa, Homo sapiens
MEQRGQNAPAASGARKRHGPGPREARGARPGLRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMESSCI

SEQ ID NO: 799540 - protein, 699 aa, Homo sapiens
AGFLPVVNAHGLARRRLLGSVTADASAGLQETQGDATRRGGRLGQRGLRLLAMGPLSARLLMQRGRPKSDRLGKIRSLDLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQPAVKLEPLHFLQCHSKNNSPQDLETQLWACAFEPAWEEGATSQTVATCGGEAVCVIDCQTGIVLHKYKAPGEEFFSVAWTALMVVTQAGHKKRWSVLAAAGLRGLVRLLHVRAGFCCGVIRAHKKAIATLCFSPAHETHLFTASYDKRIILWDIGVPNQDYEFQASQLLTLDTTSIPLRLCPVASCPDARLLAGCEGGCCCWDVRLDQPQKRRVCEVEFVFSEGSEASGRRVDGLAFVNEDIVASKGSGLGTICLWSWRQTWGGRGSQSTVAVVVLARLQWSSTELAYFSLSACPDKGIVLCGDEEGNVWLYDVSNILKQPPLLPAALQAPTQILKWPQPWALGQVVTKTMVNTVVANASFTYLTALTDSNIVAIWGRM

SEQ ID NO: 799541 - protein, 391 aa, Homo sapiens
AGFLPVVNAHGLARRRLLGSVTADASAGLQETQGDATRRGGRLGQRGLRLLAMGPLSARLLMQRGRPKSDRLGKIRSLEYEPGSGLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQLCELEHCTPAVQKQTKAQTRNSGLARPAGGGIQTALAGVCEVPSSSLSRRFGDMRDGQTMGEAHY

SEQ ID NO: 799542 - protein, 699 aa, Homo sapiens; identical to SEQ ID NO: 799540

SEQ ID NO: 799543 - protein, 699 aa, Homo sapiens; identical to SEQ ID NO: 799540

SEQ ID NO: 799544 - protein, 762 aa, Homo sapiens
AGFLPVVNAHGLARRRLLGSVTADASAGLQETQGDATRRGGRLGQRGLRLLAMGPLSARLLMQRGRPKSDRLGKIRSLDLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQPAVKLEPLHFLQCHSKNNSPQDLETQLWACAFEPAWEEGATSQTVATCGGEAVCVIDCQTGIVLHKYKAPGEEFFSVAWTALMVVTQAGHKKRWSVLAAAGLRGLVRLLHVRAGFCCGVIRAHKKAIATLCFSPAHETHLFTASYDKRIILWDIGVPNQDYEFQASQLLTLDTTSIPLRLCPVASCPDARLLAGCEGGCCCWDVRLDQPQKRRVCEVEFVFSEGSEASGRRVDGLAFVNEDIVASKGSGLGTICLWSWRQTWGGRGSQSTVAVVVLARLQWSSTELAYFSLSACPDKGIVLCGDEEGNVWLYDVSNILKQPPLLPAALQAPTQPSPLSPPDPEVAPALGPWPGGDQDHGEHSGGQCLLHLPHRPDGLQHRSHLGEDVASHHRKGPGTQLTNLFSFGPMGVGGGLSVNIFIKLYCGQENRNMTTQRNTKKMES

SEQ ID NO: 799545 - protein, 544 aa, Homo sapiens
AGFLPVVNAHGLARRRLLGSVTADASAGLQETQGDATRRGGRLGQRGLRLLAMGPLSARLLMQRGRPKSDRLGKIRSLDLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQPAVKLEPLHFLQCHSKNNSPQDLETQLWACAFEPAWEEGATSQTVATCGGEAVCVIDCQTGIVLHKYKAPGEEFFSVAWTALMVVTQAGHKKRWSVLAAAGLRGLVRLLHVRAGFCCGVIRAHKKAIATLCFSPAHETHLFTASYDKRIILWDIGVPNQDYEFQASQLLTLDTTSIPLRLCPVASCPDARLLAGCEGGCCCWDVRLDQPQKRSWTESGWAGICE

SEQ ID NO: 799546 - protein, 679 aa, Homo sapiens
QAGTAPGYGMETQGDATRRGGRLGQRGLRLLAMGPLSARLLMQRGRPKSDRLGKIRSLDLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQPAVKLEPLHFLQCHSKNNSPQDLETQLWACAFEPAWEEGATSQTVATCGGEAVCVIDCQTGIVLHKYKAPGEEFFSVAWTALMVVTQAGHKKRWSVLAAAGLRGLVRLLHVRAGFCCGVIRAHKKAIATLCFSPAHETHLFTASYDKRIILWDIGVPNQDYEFQASQLLTLDTTSIPLRLCPVASCPDARLLAGCEGGCCCWDVRLDQPQKRRVCEVEFVFSEGSEASGRRVDGLAFVNEDIVASKGSGLGTICLWSWRQTWGGRGSQSTVAVVVLARLQWSSTELAYFSLSACPDKGIVLCGDEEGNVWLYDVSNILKQPPLLPAALQAPTQILKWPQPWALGQVVTKTMVNTVVANASFTYLTALTDSNIVAIWGRM

SEQ ID NO: 799547 - protein, 385 aa, Homo sapiens
AGFLPVVNAHGLARRRLLGSVTADASAGLQETQGDATRRGGRLGQRGLRLLAMGPLSARLLMQRGRPKSDRLGKIRSLDLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQLCELEHCTPAVQKQTKAQTRNSGLARPAGGGIQTALAGVCEVPSSSLSRRFGDMRDGQTMGEAHY

SEQ ID NO: 799548 - protein, 705 aa, Homo sapiens
AGFLPVVNAHGLARRRLLGSVTADASAGLQETQGDATRRGGRLGQRGLRLLAMGPLSARLLMQRGRPKSDRLGKIRSLEYEPGSGLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQPAVKLEPLHFLQCHSKNNSPQDLETQLWACAFEPAWEEGATSQTVATCGGEAVCVIDCQTGIVLHKYKAPGEEFFSVAWTALMVVTQAGHKKRWSVLAAAGLRGLVRLLHVRAGFCCGVIRAHKKAIATLCFSPAHETHLFTASYDKRIILWDIGVPNQDYEFQASQLLTLDTTSIPLRLCPVASCPDARLLAGCEGGCCCWDVRLDQPQKRRVCEVEFVFSEGSEASGRRVDGLAFVNEDIVASKGSGLGTICLWSWRQTWGGRGSQSTVAVVVLARLQWSSTELAYFSLSACPDKGIVLCGDEEGNVWLYDVSNILKQPPLLPAALQAPTQILKWPQPWALGQVVTKTMVNTVVANASFTYLTALTDSNIVAIWGRM

SEQ ID NO: 799549 - protein, 636 aa, Homo sapiens
GWYASEVRDEKIRSLDLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQPAVKLEPLHFLQCHSKNNSPQDLETQLWACAFEPAWEEGATSQTVATCGGEAVCVIDCQTGIVLHKYKAPGEEFFSVAWTALMVVTQAGHKKRWSVLAAAGLRGLVRLLHVRAGFCCGVIRAHKKAIATLCFSPAHETHLFTASYDKRIILWDIGVPNQDYEFQASQLLTLDTTSIPLRLCPVASCPDARLLAGCEGGCCCWDVRLDQPQKRRVCEVEFVFSEGSEASGRRVDGLAFVNEDIVASKGSGLGTICLWSWRQTWGGRGSQSTVAVVVLARLQWSSTELAYFSLSACPDKGIVLCGDEEGNVWLYDVSNILKQPPLLPAALQAPTQILKWPQPWALGQVVTKTMVNTVVANASFTYLTALTDSNIVAIWGRM

SEQ ID NO: 799550 - protein, 731 aa, Homo sapiens
AGFLPVVNAHGLARRRLLGSVTADASAGLQETQGDATRRGGRLGQRGLRLLAMGPLSARLLMQRGRPKSDRLGKIRSLDGVESGVVARASSPSYSRGCGGRIPQPRSWRQLLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEKFMATLGPEEEAEKAQADFVKSAVRDVRYGPESLSEFTQWRVRMISEELVAASRTQVQKANSPEKPPEAGAAHKPRARLAALKRPDDVPLSLSPSKRACASPSAQVEGSPVAGSDGSQPAVKLEPLHFLQCHSKNNSPQDLETQLWACAFEPAWEEGATSQTVATCGGEAVCVIDCQTGIVLHKYKAPGEEFFSVAWTALMVVTQAGHKKRWSVLAAAGLRGLVRLLHVRAGFCCGVIRAHKKAIATLCFSPAHETHLFTASYDKRIILWDIGVPNQDYEFQASQLLTLDTTSIPLRLCPVASCPDARLLAGCEGGCCCWDVRLDQPQKRRVCEVEFVFSEGSEASGRRVDGLAFVNEDIVASKGSGLGTICLWSWRQTWGGRGSQSTVAVVVLARLQWSSTELAYFSLSACPDKGIVLCGDEEGNVWLYDVSNILKQPPLLPAALQAPTQILKWPQPWALGQVVTKTMVNTVVANASFTYLTALTDSNIVAIWGRM

SEQ ID NO: 799551 - protein, 658 aa, Homo sapiens
AGFLPVVNAHGLARRRLLGSVTADASAGLQETQGDATRRGGRLGQRGLRLLAMGPLSARLLMQRGRPKSDRLGKIRSLDLSGLELLSEHLDPKLLCRLTQLQELDLSNNHLETLPDNLGLSHLRVLRCANNQLGDVTALCQFPKLEELSLEGNPFLTVNDNLKVSFLLPTLRKVNGKDASSTYSQVENLNRELTSRVTAHWEVRMISEELVAASRTQVQKANSPEKPPEAGAAHKPRARLAALKRPDDVPLSLSPSKRACASPSAQVEGSPVAGSDGSQPAVKLEPLHFLQCHSKNNSPQDLETQLWACAFEPAWEEGATSQTVATCGGEAVCVIDCQTGIVLHKYKAPGEEFFSVAWTALMVVTQAGHKKRWSVLAAAGLRGLVRLLHVRAGFCCGVIRAHKKAIATLCFSPAHETHLFTASYDKRIILWDIGVPNQDYEFQASQLLTLDTTSIPLRLCPVASCPDARLLAGCEGGCCCWDVRLDQPQKRRVCEVEFVFSEGSEASGRRVDGLAFVNEDIVASKGSGLGTICLWSWRQTWGGRGSQSTVAVVVLARLQWSSTELAYFSLSACPDKGIVLCGDEEGNVWLYDVSNILKQPPLLPAALQAPTQILKWPQPWALGQVVTKTMVNTVVANASFTYLTALTDSNIVAIWGRM

SEQ ID NO: 799552 - protein, 140 aa, Homo sapiens
KGPWSWRQTWGGTICLWSWRQTWGGRGSQSTVAVVVLARLQWSSTELAYFSLSACPDKGIVLCGDEEGNVWLYDVSNILKQPPLLPAALQAPTQILKWPQPWALGQVVTKTMVNTVVANASFTYLTALTDSNIVAIWGRM

SEQ ID NO: 799553 - protein, 33 aa, Homo sapiens
MSLLIRPLKTGHSGATSQTVATCGGEAVCVIDC

SEQ ID NO: 799554 - protein, 1120 aa, Homo sapiens
AARGRRTCTRLWPERPVEKPRSAGDPGVGRARSARPRRQLCRPGEQPAGRASDIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCRCNLRNGKLREDCLTREFEAAVSCDSTAALQLGRQSETLSQPVYASLDLIVFFNRSNSLWRPSQDNISFFQGYDLRNIADDVGDGKNHGGCLTLLSEFAVDLEPELQLVRVRDLLLGHERADRAGRREALRQSPGQPLLLALVLHVPGGHIQAQGIAAHVVHGRSLGDCAAALAHHHAQLQLVVQVASVRGHEDGRALGRVGRGRLQEQHGLAQHRAAHLPDVVRVVPPHADDVLSPLPEAGQWPGCCHDSIKCPCSHVGWAGQLMPTASRRGPTASERCPPQRRPVPPRDLPGTRAAWRSASRDPLCGAKKEAEARGTALPAQLSGRRRRRSQARLPARGSRGSRRKQVERERVDWLADGARWTLIGWGQREAGADWLRRADAGVLQSWAARQSSPARVMVVGRGLLGRRSLAALGAACARRGLGPALLGVFCHTDLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVGSLNVKCLATPCHTSGHICYFVSKPGGSEPPAVFTGDTLFVAGCGKFYEGTADEMCKALLEVLGRLPPDTRVYCGHEYTINNLKFARHVEPGNAAIREKLAWAKEKYSIGEPTVPSTLAEEFTYNPFMRVREKTVQQHAGETDPVTTMRAVRREKDQFKMPRD

SEQ ID NO: 799555 - protein, 308 aa, Homo sapiens
MVVGRGLLGRRSLAALGAACARRGLGPALLGVFCHTDLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVGSLNVKCLATPCHTSGHICYFVSKPGGSEPPAVFTGDTLFVAGCGKFYEGTADEMCKALLEVLGRLPPDTRVYCGHEYTINNLKFARHVEPGNAAIREKLAWAKEKYSIGEPTVPSTLAEEFTYNPFMRVREKTVQQHAGETDPVTTMRAVRREKDQFKMPRD

SEQ ID NO: 799556 - protein, 1151 aa, Homo sapiens
AARGRRTCTRLWPERPVEKPRSAGDPGVGRARSARPRRQLCRPGEQPAGRASDIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCRCNLRNGKLREDCLTREFEAAVSCDSTAALQLGRQSETLSQPVYASLDLIVFFNRSNSLWRPSQDNISFFQGYDLRNIADDVGDGKNHGGCLTLLSEFAVDLEPELQLVRVRDLLLGHERADRAGRREALRQSPGQPLLLALVLHVPGGHIQAQGIAAHVVHGRSLGDCAAALAHHHAQLQLVVQVASVRGHEDGRALGRVGRGRLQEQHGLAQHRAAHLPDVVRVVPPHADDVLSPLPEAGQWPGCCHDSIKCPCSHVGWAGQLMPTASRRGPTASERCPPQRRPVPPRDLPGTRAAWRSASRDPLCGAKKEAEARGTALPAQLSGRRRRRSQARLPARGSRGSRRKQVERERVDWLADGARWTLIGWGSARRALIGCDAPTPVFCSPGQLGSPARPGSWWWAEGCSAAAASPRWEPPAPAEASVPKAALPGSSGGGAGAGLRGAGAGPRVRKALGPALLGVFCHTDLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVGSLNVKCLATPCHTSGHICYFVSKPGGSEPPAVFTGDTLFVAGCGKFYEGTADEMCKALLEVLGRLPPDTRVYCGHEYTINNLKFARHVEPGNAAIREKLAWAKEKYSIGEPTVPSTLAEEFTYNPFMRVREKTVQQHAGETDPVTTMRAVRREKDQFKMPRD

SEQ ID NO: 799557 - protein, 260 aa, Homo sapiens [sequence omitted]

SEQ ID NO: 799558 - protein, 1120 aa, Homo sapiens; identical to SEQ ID NO: 799554

SEQ ID NO: 799559 - protein, 1120 aa, Homo sapiens; identical to SEQ ID NO: 799554

SEQ ID NO: 799560 - protein, 1048 aa, Homo sapiens
AARGRRTCTRLWPERPVEKPRSAGDPGVGRARSARPRRQLCRPGEQPAGRASDIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCRCNLRNGKLREDCLTREFEAAVSCDSTAALQLGRQSETLSQPVYASLDLIVFFNRSNSLWRPSQDNISFFQGYDLRNIADDVGDGKNHGGCLTLLSEFAVDLEPELQLVRVRDLLLGHERADRAGRREALRQSPGQPLLLALVLHVPGGHIQAQGIAAHVVHGRSLGDCAAALAHHHAQLQLVVQVASVRGHEDGRALGRVGRGRLQEQHGLAQHRAAHLPDVVRVVPPHADDVLSPLPEAGQWPGCCHDSIKCPCSHVGWAGQLMPTASRRGPTASERCPPQRRPVPPRDLPGTRAAWRSASRDPLCGAKKEAEARGTALPAQLSGRRRRRSQARLPARGSRGSRRKQVERERVDWLADGARWTLIGWGQREAGADWLRRADAGVLQSWAARQSSPARVMVVGRGLLGRRSLAALGAACARRGLGPALLGVFCHTDLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVTPCLWLAAGSSMKGLRMRCVKLCWRSWAGSPRTQESTVATSTPSTTSSLHATWSPAMPPSGRSWPGPRRSTASGSPQCHPPWQRSLPTTPS

SEQ ID NO: 799561 - protein, 1130 aa, Homo sapiens
AARGRRTCTRLWPERPVEKPRSAGDPGVGRARSARPRRQLCRPGEQPAGRASDIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCRCNLRNGKLREDCLTREFEAAVSCDSTAALQLGRQSETLSQPVYASLDLIVFFNRSNSLWRPSQDNISFFQGYDLRNIADDVGDGKNHGGCLTLLSEFAVDLEPELQLVRVRDLLLGHERADRAGRREALRQSPGQPLLLALVLHVPGGHIQAQGIAAHVVHGRSLGDCAAALAHHHAQLQLVVQVASVRGHEDGRALGRVGRGRLQEQHGLAQHRAAHLPDVVRVVPPHADDVLSPLPEAGQWPGCCHDSIKCPCSHVGWAGQLMPTASRRGPTASERCPPQRRPVPPRDLPGTRAAWRSASRDPLCGAKKEAEARGTALPAQLSGRRRRRSQARLPARGSRGSRRKQVERERVDWLADGARWTLIGWGQREAGADWLRRADAGVLQSWAARQSSPARVMVVGRGLLGRRSLAALGAACARRGLGPALLGVFCHTDLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVGSLNVKCLATPCHTSGHICYFVSKPGGSEPPAVFTDTLFVAGCGKKRGFFFSFKFEKKGGTADEMCKALLEVLGRLPPDTRVYCGHEYTINNLKFARHVEPGNAAIREKLAWAKEKYSIGEPTVPSTLAEEFTYNPFMRVREKTVQQHAGETDPVTTMRAVRREKDQFKMPRD

SEQ ID NO: 799562 - protein, 1021 aa, Homo sapiens
AARGRRTCTRLWPERPVEKPRSAGDPGVGRARSARPRRQLCRPGEQPAGRASDIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCRCNLRNGKLREDCLTREFEAAVSCDSTAALQLGRQSETLSQPVYASLDLIVFFNRSNSLWRPSQDNISFFQGYDLRNIADDVGDGKNHGGCLTLLSEFAVDLEPELQLVRVRDLLLGHERADRAGRREALRQSPGQPLLLALVLHVPGGHIQAQGIAAHVVHGRSLGDCAAALAHHHAQLQLVVQVASVRGHEDGRALGRVGRGRLQEQHGLAQHRAAHLPDVVRVVPPHADDVLSPLPEAGQWPGCCHDSIKCPCSHVGWAGQLMPTASRRGPTASERCPPQRRPVPPRDLPGTRAAWRSASRDPLCGAKKEAEARGTALPAQLSGRRRRRSQARLPARGSRGSRRKQVERERVDWLADGARWTLIGWGQREAGADWLRRADAGVLQSWAARQSSPARVMVVGRGLLGRRSLAALGAACARRGLGPALLGVFCHTDLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVGSLNVKCLATPCHTSGHICYFVSKPGGSEPPAVFTETDHSAHHPPPLGPCWREEKLVKLESGLK

SEQ ID NO: 799563 - protein, 780 aa, Homo sapiens
AARGRRTCTRLWPERPVEKPRSAGDPGVGRARSARPRRQLCRPGEQPAGRASDIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCRCNLRNGKLREDCLTREFEAAVSCDSTAALQLGRQSETLSQPVYASLDLIVFFNRSNSLWRPSQDNISFFQGYDLRNIADDVGDGKNHGGCLTLLSEFAVDLEPELQLVRVRDLLLGHERADRAGRREALRQSPGQPLLLALVLHVPGGHIQAQGIAAHVVHGRSLGDCAAALAHHHAQLQLVVQVASVRGHEDGRALGRVGRGRLQEQHGLAQHRAAHLPDVVRVVPPHADDVLSPLPEAGQWPGCCHDSIKCPCSHVGWAGQLMPTASRRGPTASERCPPQRRPVPPRDLPGTRAAWRSASRDPLCGAKKEAEARGTALPAQLSGRRRRRSQARLPARGSRGSRRKQVERERVDWLADGARWTLIG

SEQ ID NO: 799564 - protein, 936 aa, Homo sapiens
AARGRRTCTRLWPERPVEKPRSAGDPGVGRARSARPRRQLCRPGEQPAGRASDIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCRCNLRNGKLREDCLTREFEAAVSCDSTAALQLGRQSETLSQPVYASLDLIVFFNRSNSLWRPSQDNISFFQGYDLRNIADDVGDGKNHGGCLTLLSEFAVDLEPELQLVRVRDLLLGHERADRAGRREALRQSPGQPLLLALVLHVPGGHIQAQGIAAHVVHGRSLGDCAAALAHHHAQLQLVVQVASVRGHEDGRALGRVGRGRLQEQHGLAQHRAAHLPDVVRVVPPHADDVLSPLPEAGQWPGCCHDSIKCPCSHVGWAGQLMPTASRRGPTASERCPPQRRPVPPRDLPGTRAAWRSASRDPLCGAKKEAEARGTALPAQLSGRRRRRSQARLPARGSRGSRRKQVERERVDWLADGARWTLIGWGQREAGADWLRRADAGVLQSWAARQSSPARVMVVGRGLLGRRSLAALGAACARRGLGPALLGVFCHTDLRKNLTVDEGTMKVEVLPALTDNYMYLVIDDETKEAAIVDPVQPQKVVDAARKHGVKLTTVLTTHHHWDHAGGNEKLVKLDFSGFGD

SEQ ID NO: 799565 - protein, 411 aa, Homo sapiens
AARGRRTCTRLWPERPVEKPRSAGDPGVGRARSARPRRQLCRPGEQPAGRASDIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLG

SEQ ID NO: 799566 - protein, 1079 aa, Homo sapiens
AARGRRTCTRLWPERPVEKPRSAGDPGVGRARSARPRRQLCRPGEQPAGRASDIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCRCNLRNGKLREDCLTREFEAAVSCDSTAALQLGRQSETLSQPVYASLDLIVFFNRSNSLWRPSQDNISFFQGYDLRNIADDVGDGKNHGGCLTLLSEFAVDLEPELQLVRVRDLLLGHERADRAGRREALRQSPGQPLLLALVLHVPGGHIQAQGIAAHVVHGRSLGDCAAALAHHHAQLQLVVQVASVRGHEDGRALGRVGRGRLQEQHGLAQHRAAHLPDVVRVVPPHADDVLSPLPEAGQWPGCCHDSIKCPCSHVGWAGQLMPTASRRGPTASERCPPQRRPVPPRDLPGTRAAWRSASRDPLCGAKKEAEARGTALPAQLSGRRRRRSQARLPARGSRGSRRKQVERERVDWLADGARWTLIGWGSARRALIGCDAPTPVFCSPGQLGSPARPGSWWWAEGCSAAAASPRWEPPAPAEASVPKAALPGSSGGGAGAGLRGAGAGPRVRKALGPALLGVFCHTDLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVTPCLWLAAGSSMKGLRMRCVKLCWRSWAGSPRTQESTVATSTPSTTSSLHATWSPAMPPSGRSWPGPRRSTASGSPQCHPPWQRSLPTTPS

SEQ ID NO: 799567 - protein, 292 aa, Homo sapiens
MVDLWLAAGADLRKNLTVDEGTMKVEVLPALTDNYMYLVIDDETKEAAIVDPVQPQKVVDAARKHGVKLTTVLTTHHHWDHAGGNEKLVKLESGLKVYGGDDRIGALTHKITHLSTLQVGSLNVKCLATPCHTSGHICYFVSKPGGSEPPAVFTDTLFVAGCGKKRGFFFSFKFEKKGGTADEMCKALLEVLGRLPPDTRVYCGHEYTINNLKFARHVEPGNAAIREKLAWAKEKYSIGEPTVPSTLAEEFTYNPFMRVREKTVQQHAGETDPVTTMRAVRREKDQFKMPRD

SEQ ID NO: 799568 - protein, 917 aa, Homo sapiens
AARGRRTCTRLWPERPVEKPRSAGDPGVGRARSARPRRQLCRPGEQPAGRASDIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCRCNLRNGKLREDCLTREFEAAVSCDSTAALQLGRQSETLSQPVYASLDLIVFFNRSNSLWRPSQDNISFFQGYDLRNIADDVGDGKNHGGCLTLLSEFAVDLEPELQLVRVRDLLLGHERADRAGRREALRQSPGQPLLLALVLHVPGGHIQAQGIAAHVVHGRSLGDCAAALAHHHAQLQLVVQVASVRGHEDGRALGRVGRGRLQEQHGLAQHRAAHLPDVVRVVPPHADDVLSPLPEAGQWPGCCHDSIKCPCSHVGWAGQLMPTASRRGPTASERCPPQRRPVPPRDLPGTRAAWRSASRDPLCGAKKEAEARGTALPAQLSGRRRRRSQARLPARGSRGSRRKQVERERVDWLADGARWTLIGWGQREAGADWLRRADAGVLQSWAARQSSPARVMVVGRGLLGRRSLAALGAACARRGLGPALLGVFCHTDLRKNLTVDEGTMKVEVLPALTDNYMYLVIDDETKEAAIVDPVQPQKVVDAARKHGVKLTTVLTTHHHW

SEQ ID NO: 799569 - protein, 477 aa, Homo sapiens
AARGRRTCTRLWPERPVEKPRSAGDPGVGRARSARPRRQLCRPGEQPAGRASDIGSERYTFSFTIRDSPAHFVNAASWGNEDYIKSLSDSFRVGDCVIIENPLIQRKEIEREEKFSPATPSNCKLLLSENHSTVKVCSSYEVDTKLLSLIHLPVKESHDYYSLGDIVANGHSLNGRIINVLAAVKSVGEPKYFTTSDRRKGQRCEVRLYDETESSFAMTCWDNESILLAQSWMPRETVIFASDVRINFDKFRNCMTATVISKTIITTNPEANILLNFIRENKETNVLDDEIDSYFKESINLSTIVDVYTVEQLKGKALKNEGKADPSYGILYAYISTLNIDDETTKVVRNRCSSCGYIVNEASNMCTTCNKNSLDFKSVFLSFHVLIDLTDHTGTLHSCSLTGSVAEETLGCVHEFLAMTDEQKTALKWQFLLERSKIYLKFVLSHRARSGLKISVLSCKLADPTEASRNLSGQKHV

SEQ ID NO: 799570 - protein, 253 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQVWMAS

SEQ ID NO: 799571 - protein, 271 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQDGERDLEEARNFSKKSKESVSSS

SEQ ID NO: 799572 - protein, 253 aa, Homo sapiens; identical to SEQ ID NO: 799570

SEQ ID NO: 799573 - protein, 219 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSYT

SEQ ID NO: 799574 - protein, 253 aa, Homo sapiens; identical to SEQ ID NO: 799570

SEQ ID NO: 799575 - protein, 253 aa, Homo sapiens; identical to SEQ ID NO: 799570

SEQ ID NO: 799576 - protein, 253 aa, Homo sapiens; identical to SEQ ID NO: 799570

SEQ ID NO: 799577 - protein, 258 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQVKSGKKRRRT

SEQ ID NO: 799578 - protein, 257 aa, Homo sapiens
MASGILVNVKEEVTCPICLELLTQPLSLDCGHSFCQACLTANHKKSMLDKGESSCPVCRISYQPENIRPNRHVANIVEKLREVKLSPEGQKVDHCARHGEKLLLFCQEDGKVICWLCERSQEHRGHHTFLTEEVAREYQVKLQAALEMLRQKQQEAEELEADIREEKASWKTQIQYDKTNVLADFEQLRDILDWEESNELQNLEKEEEDILKSLTNSETEMVQQTQSLRELISDLEHRLQGSVMELLQVKSGKKPEH

SEQ ID NO: 799579 - protein, 102 aa, Homo sapiens
MGTSVAHRRPLPTISLFSEHLLKHLMLKPALHQEALLDPKVGLASLLGLPQLENMTSCDLLDLELPHHQECPAEVGLIVYHLCRAQDNPCMCQMCRKYLLME

SEQ ID NO: 799580 - protein, 917 aa, Homo sapiens
MGLFRGFVFLLVLCLLHQSNTSFIKLNNNGFEDIVIVIDPSVPEDEKIIEQIEDMVTTASTYLFEATEKRFFFKNVSILIPENWKENPQYKRPKHENHKHADVIVAPPTLPGRDEPYTKQFTECGEKGEYIHFTPDLLLGKKQNEYGPPGKLFVHEWAHLRWGVFDEYNEDQPFYRAKSKKIEATRCSAGISGRNRVYKCQGGSCLSRACRIDSTTKLYGKDCQFFPDKVQTEKASIMFMQSIDSVVEFCNEKTHNQEAPSLQNIKCNFRSTWEVISNSEDFKNTIPMVTPPPPPVFSLLKIRQRIVCLVLDKSGSMGGKDRLNRMNQAAKHFLLQTVENGSWVGMVHFDSTATIVNKLIQIKSSDERNTLMAGLPTYPLGGTSICSGIKYAFQVIGELHSQLDGSEVLLLTDGEDNTASSCIDEVKQSGAIVHFIALGRAADEAVIEMSKITGGSHFYVSDEAQNNGLIDAFGALTSGNTDLSQKSLQLESKGLTLNSNAWMNDTVIIDSTVGKDTFFLITWNSLPPSISLWDPSGTIMENFTVDATSKMAYLSIPGTAKVGTWAYNLQAKANPETLTITVTSRAANSSVPPITVNAKMNKDVNSFPSPMIVYAEILQGYVPVLGANVTAFIESQNGHTEVLELLDNGAGADSFKNDGVYSRYFTAYTENGRYSLKVRAHGGANTARLKLRPPLNRAAYIPGWVVNGEIEANPPRPEIDEDTQTTLEDFSRTASGGAFVVSQVPSLPLPDQYPPSQITDLDATVHEDKIILTWTAPGDNFDVGKVQRYIIRISASILDLRDSFDDALQVNTTDLSPKEANSKESFAFKPENISEENATHIFIAIKSIDKSNLTSKVSNIAQVTLFIPQANPDDIDPTPTPTPTPDKSHNSGVNISTLVLSVIGSVVIVNFILSTTI

SEQ ID NO: 799581 - protein, 472 aa, Homo sapiens
MGLFRGFVFLLVLCLLHQSNTSFIKLNNNGFEDIVIVIDPSVPEDEKIIEQIEDMVTTASTYLFEATEKRFFFKNVSILIPENWKENPQYKRPKHENHKHADVIVAPPTLPGRDEPYTKQFTECGEKGEYIHFTPDLLLGKKQNEYGPPGKLFVHEWAHLRWGVFDEYNEDQPFYRAKSKKIEATRCSAGISGRNRVYKCQGGSCLSRACRIDSTTKLYGKDCQFFPDKVQTEKASIMFMQSIDSVVEFCNEKTHNQEAPSLQNIKCNFRSTWEVISNSEDFKNTIPMVTPPPPPVFSLLKIRQRIVCLVLDKSGSMGGKDRLNRMNQAAKHFLLQTVENGSWVGMVHFDSTATIVNKLIQIKSSDERNTLMAGLPTYPLGGTSICSGIKYAFQVIGELHSQLDGSEVLLLTDGEDNTASSCIDEVKQSGAIVHFIALGRAADEAVIEMSKITGKTRSIYSRPSIVMHKCKG

SEQ ID NO: 799582 - protein, 221 aa, Homo sapiens
VDRIVGELGVNGEIEANPPRPEIDEDTQTTLEDFSRTASGGAFVVSQVPSLPLPDQYPPSQITDLDATVHEDKIILTWTAPGDNFDVGKVQRYIIRISASILDLRDSFDDALQVNTTDLSPKEANSKESFAFKPENISEENATHIFIAIKSIDKSNLTSKVSNIAQVTLFIPQANPDDIDPTPTPTPTPDKSHNSGVNISTLVLSVIGSVVIVNFILSTTI

SEQ ID NO: 799583 - protein, 70 aa, Homo sapiens
MSGARRAAPGTSNAAKGSCTYPRAARERLLRALLSLVFCTAPARRSRLRGPMARRDSGMAVCHGCEPPLG

SEQ ID NO: 799584 - protein, 70 aa, Homo sapiens; identical to SEQ ID NO: 799583

SEQ ID NO: 799585 - protein, 108 aa, Homo sapiens
MIEAEEQQPCKTDFYSELPKVELHAHLNGSISSHTMKKLIAQKPDLKIHDQMTVIDKGKKRTCGRMFQMFQTIHQLTSSPEDILMVTKDVIKEFADDGVKYLELRSTP

SEQ ID NO: 799586 - protein, 108 aa, Homo sapiens
MIEAEEQQPCKTDFYSELPKVELHAHLNGSISSHTMKKLIAQKPDLKIHDQMTVIDKGKKRTLEECFQMFQTIHQLTSSPEDILMVTKDVIKEFADDGVKYLELRSTP

SEQ ID NO: 799587 - protein, 80 aa, Homo sapiens
GSGGCPFRAEPGSSFLSAPPPPHRLATGHRSGATGFFPTPPPPADQRPQRPPRAGRLRPTGTPLPLEGGGRFHAYDRARP

SEQ ID NO: 799588 - protein, 123 aa, Homo sapiens
TTRGRRPGNCRPALRNLTHRRAAAGGCTRRARCSKPRERRTPLGQRDGREAREAGERRRRPPYLSRCPERAGTCPSPPHSPPRTGSTRPRPPTRKPCSSAVVGTAAGPCAPPPAAFPTPLPRE

SEQ ID NO: 799589 - protein, 871 aa, Homo sapiens
RHRSAPGPRRVPAPRVGPAQPGPPATCASQPCAEQAAMWGLGARGPDRGLLLALALGGLARAGGVEVEPGGAHGESGGFQVVTFEWAHVQDPYVIALWILVASLAKIGFHLSHKVTSVVPESALLIVLGLVLGGIVWAADHIASFTLTPTVFFFYLLPPIVLDAGYFMPNRLFFGNLGTILLYAVVGTVWNAATTGLSLYGVFLSGLMGDLQIGLLDFLLFGSLMAAVDPVAVLAVFEEVHVNEVLFIIVFGESLLNDAVTVVLYNVFESFVALGGDNVTGVDCVKGIVSFFVVSLGGTLVGVVFAFLLSLVTRFTKHVRIIEPGFVFIISYLSYLTSEMLSLSAILAITFCGICCQKYVKANISEQSATTVRYTMKMLASSAETIIFMFLGISAVNPFIWTWNTAFVLLTLVFISVYRAIGVVLQTWLLNRYRMVQLEPIDQVVLSYGGLRGAVAFALVVLLDGDKVKEKNLFVSTTIIVVFFTVIFQGLTIKPLVQWLKVKRSEHREPRLNEKLHGRAFDHILSAIEDISGQIGHNYLRDKWSHFDRKFLSRVLMRRSAQKSRDRILNVFHELNLKDAISYVAEGERRGSLAFIRSPSTDNVVNVDFTPRSSTVEASVSYLLRENVSAVCLDMQSLEQRRRSIRDAEDMVTHHTLQQYLYKPRQEYKHLYSRHELTPTEDEKQDREIFHRTMRKRLESFKSTKLGLNQNKKAAKLYKRERAQKRRNSSIPNGKLPMESPAQNFTIKEKDLELSDTEEPPNYDEEMSGGIEFLASVTKDTASDSPAGIDNPVFSPDEALDRSLLARLPPWLSPGETVVPSQRARTQIPYSPGTFRRLMPFRLSSKSVDSFLQADGPEERPPAALPESTHM

SEQ ID NO: 799590 - protein, 399 aa, Homo sapiens
RHRSAPGPRRVPAPRVGPAQPGPPATCASQPCAEQAAMWGLGARGPDRGLLLALALGGLARAGGVEVEPGGAHGESGGFQVVTFEWAHVQDPYVIALWILVASLAKIGFHLSHKVTSVVPESALLIVLGLVLGGIVWAADHIASFTLTPTAFLLSLVTRFTKHVRIIEPGFVFIISYLSYLTSEMLSLSAILAITFCGICCQKYVKANISEQSATTVRYTMKMLASSAETIIFMFLGISAVNPFIWTWNTAFVLLTLVFISVYRAIGVVLQTWLLNRYRMVQLEPIDQVVLSYGGLRGAVAFALVVLLDGDKVKEKNLFVSTTIIVVFFTVIFQGLTIKPLVQWLKVKRSEHREPRLNEKLHGRAFDHILSAIEDISGQIGHNYLRDKAQACNPSTLGD

SEQ ID NO: 799591 - protein, 347 aa, Homo sapiens
ADAGVPESYSQGFGEGPVRKGTHFRQEARKASWGVSLSPEGRRGWPDGRCPRAPAGCPPWEGEGHAGGSQGQMPAVGRRGARKRPHPEGACMAQRWSPRRRENVSAVCLDMQSLEQRRRSIRDAEDMVTHHTLQQYLYKPRQEYKHLYSRHELTPTEDEKQDREIFHRTMRKRLESFKSTKLGLNQNKKAAKLYKRERAQKRRNSSIPNGKLPMESPAQNFTIKEKDLELSDTEEPPNYDEEMSGGIEFLASVTKDTASDSPAGIDNPVFSPDEALDRSLLARLPPWLSPGETVVPSQRARTQIPYSPGTFRRLMPFRLSSKSVDSFLQADGPEERPPAALPESTHM

SEQ ID NO: 799592 - protein, 581 aa, Homo sapiens
MAVAGAVSGEPLVHWCTQQLRKTFGLDVSEEIIQYVLSIESAEEIREYVTDLLQGNEGKKGQFIEELITKWQKNDQELISDPLQQCFKKDEILDGQKSGDHLKRGRKKGRNRQEVPAFTEPDTTAEVKTPFDLAKAQENSNSVKKKTKFVNLYTREGQDRLAVLLPGRHPCDCLGQKHKLINNCLICGRIVCEQEGSGPCLFCGTLVCTHEEQDILQRDSNKSQKLLKKLMSGVENSGKVDISTKDLLPHQELRIKSGLEKAIKHKDKLLEFDRTSIRRTQVIDDESDYFASDSNQWLSKLERETLQKREEELRELRHASRLSKKVTIDFAGRKILEEENSLAEYHSRLDETIQAIANGTLNQPLTKLDRSSEEPLGVLVNPNMYQSPPQWVDHTGAASQKKAFRSSGFGLEFNSFQHQLRIQDQEFQEGFDGGWCLSVHQPWASLLVRGIKRVEGRSWYTPHRGRLWIAATAKKPSPQEVSELQATYRLLRGKDVEFPNDYPSGCLLGCVDLIDCLSQKQFKEQFPDISQESDSPFVFICKNPQEMVVKFPIKGNPKIWKLDSKIHQGAKKGLMKQNKAV

SEQ ID NO: 799593 - protein, 351 aa, Homo sapiens
MSGVENSGKVDISTKDLLPHQELRIKSGLEKAIKHKDKLLEFDRTSIRRTQVIDDESDYFASDSNQWLSKLERETLQKREEELRELRHASRLSKKVTIDFAGRKILEEENSLAEYHSRLDETIQAIANGTLNQPLTKLDRSSEEPLGVLVNPNMYQSPPQWVDHTGAASQKKAFRSSGFGLEFNSFQHQLRIQDQEFQEGFDGGWCLSVHQPWASLLVRGIKRVEGRSWYTPHRGRLWIAATAKKPSPQEVSELQATYRLLRGKDVEFPNDYPSGCLLGCVDLIDCLSQKQFKEQFPDISQESDSPFVFICKNPQEMVVKFPIKGNPKIWKLDSKIHQGAKKGLMKQNKAV

SEQ ID NO: 799594 - protein, 581 aa, Homo sapiens; identical to SEQ ID NO: 799592

SEQ ID NO: 799595 - protein, 269 aa, Homo sapiens
MAVAGAVSGEPLVHWCTQQLRKTFGLDVSEEIIQYVLSIESAEEIREYVTDLLQGNEGKKGQFIEELITKWQKNDQELISDPLQQCFKKDEILDGQKSGDHLKRGRKKGRNRQEVPAFTEPDTTAEVKTPFDLAKAQENSNSVKKKTKFVNLYTREGQDRLAVLLPGRHPCDCLGQKHKLINNCLICGRIVCEQEGSGPCLFCGTLVCTHEEQDILQRDSNKSQKLLKKLMSVFEGPKSLMMSQITLPVILTNGCPNLSGKPCRSERRS

SEQ ID NO: 799596 - protein, 198 aa, Homo sapiens [sequence omitted]

SEQ ID NO: 799597 - protein, 532 aa, Homo sapiens
MAVAGAVSGEPLVHWCTQQLRKTFGLDVSEEIIQYVLSIESAEEIREYVTDLLQGNEGKKGQFIEELITKWQKNDQELISDPLQQCFKKDEILDGQKSGDHLKRGRKKGRNRQEVPAFTEPDTTAEVKTPFDLAKAQENSNSVKKKTKFVNLYTREGQDRLAVLLPGRHPCDCLGQKHKLINNCLICGRIVCEQEGSGPCLFCGTLVCTHEEQDILQRDSNKSQKLLKKLMSGVENSGKVDISTKDLLPHQELRIKSGLEKAIKHKDKLLEFDRTSIRRTQVIDDESDYFASDSNQWLSKLERETLQKREEELRELRHASRLSKKVTIDFAGRKILEEENSLAEYHSRLDETIQAIANGTLNQPLTKLDRSSEEPLGVLVNPNMYQSPPQWVDHTGAASQKKAFRSSGFGLEFNSFQHQLRIQDQEFQEGFDGGWCLSVHQPWASLLVRGIKRVEGRSWYTPHRGRLWIAATAKKPSPQEVSELQATYRLLRGKEVTAAYSPFNFTLWREVIDVHLLSLPSFFGFFFVKRDF

SEQ ID NO: 799598 - protein, 83 aa, Homo sapiens
KEISESPDSWLFVIKEHSVLILLGGFQFPDISQESDSPFVFICKNPQEMVVKFPIKGNPKIWKLDSKIHQGAKKGLMKQNKAV

SEQ ID NO: 799599 - protein, 86 aa, Homo sapiens
VLRRELVRCRTWGFCSSAGSGWGRWRWLGRCPGSRWCTGAPSSCGRLSAWMSARRSFSENSSGPSGEGALGCALPERTGKRGGLKS

SEQ ID NO: 799600 - protein, 581 aa, Homo sapiens; identical to SEQ ID NO: 799592

SEQ ID NO: 799601 - protein, 579 aa, Homo sapiens
MKFRFPKYFRNHVIQAGEDGGGWGGVRGAAGALVHPAVAEDFRPGCQRGDHSGNEGKKGQFIEELITKWQKNDQELISDPLQQCFKKDEILDGQKSGDHLKRGRKKGRNRQEVPAFTEPDTTAEVKTPFDLAKAQENSNSVKKKTKFVNLYTREGQDRLAVLLPGRHPCDCLGQKHKLINNCLICGRIVCEQEGSGPCLFCGTLVCTHEEQDILQRDSNKSQKLLKKLMSGVENSGKVDISTKDLLPHQELRIKSGLEKAIKHKDKLLEFDRTSIRRTQVIDDESDYFASDSNQWLSKLERETLQKREEELRELRHASRLSKKVTIDFAGRKILEEENSLAEYHSRLDETIQAIANGTLNQPLTKLDRSSEEPLGVLVNPNMYQSPPQWVDHTGAASQKKAFRSSGFGLEFNSFQHQLRIQDQEFQEGFDGGWCLSVHQPWASLLVRGIKRVEGRSWYTPHRGRLWIAATAKKPSPQEVSELQATYRLLRGKDVEFPNDYPSGCLLGCVDLIDCLSQKQFKEQFPDISQESDSPFVFICKNPQEMVVKFPIKGNPKIWKLDSKIHQGAKKGLMKQNKAV

SEQ ID NO: 799602 - protein, 351 aa, Homo sapiens; identical to SEQ ID NO: 799593

SEQ ID NO: 799603 - protein, 537 aa, Homo sapiens
MAVAGAVSGEPLVHWCTQQLRKTFGLDVSEEIIQYVLSIESAEEIREYVTDLLQGNEGKKGQFIEELITKWQKNDQELISDPLQQCFKKDEILDGQKSGDHLKRGRKKGRNRQEVPAFTEPDTTAEVKTPFDLAKAQENSNSVKKKTKFVNLYTREGQDRLAVLLPGRHPCDCLGQKHKLINNCLICGRIVCEQEGSGPCLFCGTLVCTHEEQDILQRDSNKSQKLLKKLMSGVENSGKVDISTKDLLPHQELRIKSGLEKAIKHKDKLLEFDRTSIRRTQVIDDESDYFASDSNQWLSKLERETLQKREEELRELRHASRLSKKVTIDFAGRKILEEENSLAEYHSRLDETIQAIANGTLNQPLTKLDRSSEEPLGVLVNPNMYQSPPQWVDHTGAASQKKAFRSSGFGLEFNSFQHQLRIQDQEFQEGFDGGWCLSVHQPWASLLVRGIKRVEGRSWYTPHRGRLWIAATAKKPSPQEVSELQATYRLLRGKEVTAAYSPFNFTLWREVIDVHLLSLPSSWFSVKKFIWYVGRES

SEQ ID NO: 799604 - protein, 368 aa, Homo sapiens
MAVAGAVSGEPLVHWCTQQLRKTFGLDVSEEIIQYVLSIESAEEIREYVTDLLQGNEGKKGQFIEELITKWQKNDQELISDPLQQCFKKDEILDGQKSGDHLKRGRKKGRNRQEVPAFTEPDTTAEVKTPFDLAKAQENSNSVKKKTKFVNLYTREGQDRLAVLLPGRHPCDCLGQKHKLINNCLICGRIVCEQEGSGPCLFCGTLVCTHEEQDILQRDSNKSQKLLKKLMSGVENSGKVDISTKDLLPHQELRIKSGLEKAIKHKDKLLEFDRTSIRRTQVIDDESDYFASDSNQWLSKLERETLQKREEELRELRHASRLSKKVTIDFAGRKILEEENSLAEYHSSGLTTQVQPHRRRLSVLQDLD

SEQ ID NO: 799605 - protein, 70 aa, Homo sapiens
DTGYELRINSNDFYFPDISQESDSPFVFICKNPQEMVVKFPIKGNPKIWKLDSKIHQGAKKGLMKQNKAV

SEQ ID NO: 799606 - protein, 187 aa, Homo sapiens
MLGWIKRLIRMVFQQVGVSMQSVLWSRKPYGSSRSIVRKIGTNLSLIQCPRVQFQINSHATEWSPSHPGEDAVASFADVGWVAKEEGECSARLRTEVRSRPPLQDDLLFFEKAPSRQISLPDLSQEEPQLKTPALANEEALQKICALENELAALRAQIAKIVTQQEQQNLTAGDLDSTTFGTIQRKK

SEQ ID NO: 799607 - protein, 333 aa, Homo sapiens
MLGWIKRLIRMVFQQVGVSMQSVLWSRKPYGSSRSIVRKIGTNLSLIQCPRVQFQINSHATEWSPSHPGEDAVASFADVGWVAKEEGECSARLRTEVRSRPPLQDDLLFFEKAPSRQISLPDLSQEEPQLKTPALANEEALQKICALENELAALRAQIAKIVTQQEQQNLTAGDLDSTTFGTIPPHPPPPPPPLPPPALGLHQSTSAVDLIKERREKRANAGKTLVKNNPKKPEMPNMLEILKEMNSVKLRSVKRSEQDVKPKPVDATDPAALIAEALKKKFAYRYRSDSQDEVEKGIPKSESEATSERVLFGPHMLKPTGKMKALIENVSDS

SEQ ID NO: 799608 - protein, 333 aa, Homo sapiens; identical to SEQ ID NO: 799607

SEQ ID NO: 799609 - protein, 333 aa, Homo sapiens; identical to SEQ ID NO: 799607

SEQ ID NO: 799610 - protein, 154 aa, Homo sapiens
MLGWIKRLIRMVFQQVGVSMQSVLWSRKPYGSSRSIVRKIGTNLSLIQCPRVQFQINSHATEWSPSHPGEDAVASFADVGWVAKEEGECSARLRTEVRSRPPLQDDLLFFEKAPSRQISLPDLSQEEPQLKTPALANEEALQKICALENELVLI

SEQ ID NO: 799611 - protein, 328 aa, Homo sapiens
MLGWIKRLIRMVFQQVGVSMQSVLWSRKPYGSSRSIVRKIGTNLSLIQCPRVQFQINSHATEWSPSHPGEDAVASFADVGWVAKEEGECSARLRTEVRSRPPLQDDLLFFEKAPSRQISLPDLSQEEPQLKTPALANEEALQKICALENELAALRAQIAKIVTQQEQQNLTAGDLDSTTFGTIPPHPPPPPPPLPPPALGLHQSTSAVDLIKERREKRANAGKTLVKNNPKKPEMPNMLEILKEMNSVKLRSVKRSEQDVKPKPVDATDPAALIAEALKKKFAYRYRSDSQDEVEKGIPKSESEATSERVLSLPAGFIQPHVSKHCLG

SEQ ID NO: 799612 - protein, 328 aa, Homo sapiens; identical to SEQ ID NO: 799611

SEQ ID NO: 799613 - protein, 328 aa, Homo sapiens; identical to SEQ ID NO: 799611

SEQ ID NO: 799614 - protein, 187 aa, Homo sapiens; identical to SEQ ID NO: 799606

SEQ ID NO: 799615 - protein, 333 aa, Homo sapiens; identical to SEQ ID NO: 799607

SEQ ID NO: 799616 - protein, 333 aa, Homo sapiens; identical to SEQ ID NO: 799607

SEQ ID NO: 799617 - protein, 325 aa, Homo sapiens
MQSVLWSRKPYGSSRSIVRKIGTNLSLIQCPRVQFQLCRTGPCWEPSINSHATEWSPSHPGEDAVASFADVGWVAKEEGECSARLRTEVRSRPPLQDDLLFFEKAPSRQISLPDLSQEEPQLKTPALANEEALQKICALENELAALRAQIAKIVTQQEQQNLTAGDLDSTTFGTIPPHPPPPPPPLPPPALGLHQSTSAVDLIKERREKRANAGKTLVKNNPKKPEMPNMLEILKEMNSVKLRSVKRSEQDVKPKPVDATDPAALIAEALKKKFAYRYRSDSQDEVEKGIPKSESEATSERVLFGPHMLKPTGKMKALIENVSDS

SEQ ID NO: 799618 - protein, 143 aa, Homo sapiens [sequence omitted]

SEQ ID NO: 799619 - protein, 371 aa, Homo sapiens
MLGWIKRLIRMVFQQVGVSMQSVLWSRKPYGSSRSIVRKIGTNLSLIQCPRVQFQINSHATEWSPSHPGEDAVASFADVGWVAKEEGECSARLRTEVRSRPPLQDDLLFFEKAPSRQISLPDLSQEEPQLKTPALANEEALQKICALENELAALRAQIAKIVTQQEQQNLTAGDLDSTTFGTIPPHPPPPPPPLPPPALGLHQSTSAVDLIKERREKRANAGKTLVKNNPKKPEMPNMLEILKEMNSVKLRSVKRSEQDVKPKPVDATDPAALIAEALKKKFAYRYRSDSQDEVEKGIPKSESEATSERVLKRLVKVRTCWTRRPMANPTEDKFISLKRIRTMTKTIQTTIIHGRKYCGIYIIKWLRSFFC

SEQ ID NO: 799620 - protein, 328 aa, Homo sapiens; identical to SEQ ID NO: 799611

SEQ ID NO: 799621 - protein, 762 aa, Homo sapiens
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDQWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKKSKPILCPALSSLVIYLKSVSFRSFTHSKEHYHFYEISSFSETKAKRLIKEAGNEFVQHNTWQLSRVYPSGLRTDSSNYNPQELWNAGCQMVAMNMQTAGLEMDICDGHFRQNGGCGYVLKPDFLRDIQSSFHPEKPISPFKAQTLLIQVISGQQLPKVDKTKEGSIVDPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 799622 - protein, 755 aa, Homo sapiens
MANSVEEAQIWMRGLQLLVDLVTSMDHQERLDQYRQDGVRVGVRDTLSLKEPDATGLGKAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKKSKPILCPALSSLVIYLKSVSFRSFTHSKEHYHFYEISSFSETKAKRLIKEAGQDQNGGMGREVGWIGSGLMDWQVSPKKKDKVAKEDEGVQKLLRADKGRGVMNSGFKGLGAGKLVWMDRVERHSETFWSQLQMLERRVKSRQVLGTREVGDSTPLPSPSLYPFTGNEFVQHNTWQLSRVYPSGLRTDSSNYNPQELWNAGCQMVAMNMQTAGLEMDICDGHFRQNGGCGYVLKPDFLRDIQSSFHPEKPISPFKAQTLLIQVISGQQLPKVDKTKEGSIVDPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 799623 - protein, 571 aa, Homo sapiens
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDQWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKKSKPILCPALSSLVIYLKSVSFRSFTHSKEHYHFYEISSFSETKAKRLIKEAGQDQNGGMGREVGWIGSGLMDWQVSPKKKDKVAKER

SEQ ID NO: 799624 - protein, 571 aa, Homo sapiens; identical to SEQ ID NO: 799623

SEQ ID NO: 799625 - protein, 571 aa, Homo sapiens; identical to SEQ ID NO: 799623

SEQ ID NO: 799626 - protein, 229 aa, Homo sapiens
MLSVDITSRYRAPSTYLLNSLKEGLEGLHGESCSSFLLGPSVAMNMQTAGLEMDICDGHFRQNGGCGYVLKPDFLRDIQSSFHPEKPISPFKAQTLLIQVISGQQLPKVDKTKEGSIVDPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 799627 - protein, 785 aa, Homo sapiens
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDQWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKKSKPILCPALSSLVIYLKSVSFRSFTHSKEHYHFYEISSFSETKAKRLIKEAGQDQNGGMGREVGWIGSGLMELAGNEFVQHNTWQLSRVYPSGLRTDSSNYNPQELWNAGCQMVAMNMQTAGLEMDICDGHFRQNGGCGYVLKPDFLRDIQSSFHPEKPISPFKAQTLLIQVISGQQLPKVDKTKEGSIVDPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 799628 - protein, 571 aa, Homo sapiens; identical to SEQ ID NO: 799623

SEQ ID NO: 799629 - protein, 571 aa, Homo sapiens; identical to SEQ ID NO: 799623

SEQ ID NO: 799630 - protein, 571 aa, Homo sapiens; identical to SEQ ID NO: 799623

SEQ ID NO: 799631 - protein, 494 aa, Homo sapiens
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDQWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKVSQEWSFCCGI

SEQ ID NO: 799632 - protein, 365 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 799633 - protein, 429 aa, Homo sapiens
MRLYGGILGFFRYEEGIVVSLDRARRAPPRRPGPGRARGVPGGRGGPGVGRSHVPPPAPGRPLSMGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 799634 - protein, 365 aa, Homo sapiens; identical to SEQ ID NO: 799632

SEQ ID NO: 799635 - protein, 361 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELGEVPPGGDAPGFPLPCLTAAPVLPESDLPPHCCHLLESDCLEPHACQCPQNLMACPSQGQLPSVSCCFWPH

SEQ ID NO: 799636 - protein, 349 aa, Homo sapiens
GSETQLKEQSHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 799637 - protein, 390 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKVRFRSGGARGRVHAPGPRLLCLGAPGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 799638 - protein, 291 aa, Homo sapiens
GTFSPKALKASTKSFSGSLDLWSLSPNTRTPGFPSPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 799639 - protein, 272 aa, Homo sapiens
QYPGCKLSHARVEGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 799640 - protein, 225 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKDTVSHYVAQAGLELLGSSDSPALVS

SEQ ID NO: 799641 - protein, 348 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKASVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 799642 - protein, 161 aa, Homo sapiens
MRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 799643 - protein, 365 aa, Homo sapiens; identical to SEQ ID NO: 799632

SEQ ID NO: 799644 - protein, 365 aa, Homo sapiens; identical to SEQ ID NO: 799632

SEQ ID NO: 799645 - protein, 449 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKDTVSHYVAQAGLELLGSSDFSCFGLLSELRLQALALLPRLECSSGIRVHCSLNLPSSSDPPTLPFLNGMGPQEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPALLWRRMRSGLPAPWISLRGDDTGVLLPTPGEAQDADLKDVNVIPATA

SEQ ID NO: 799646 - protein, 357 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPALGPKRGLPPREANVIEDVIDHHADIAF

SEQ ID NO: 799647 - protein, 361 aa, Homo sapiens; identical to SEQ ID NO: 799635

SEQ ID NO: 799648 - protein, 148 aa, Homo sapiens
TTTTTTTKFAAASTLREDDRRGSGPSCPPSGAPSCGLPQFPLLIHMAVFHLDNITRVWARKKKEEKKKKSYRMSADMMMECRPGNSPVLGRPASFGRSRLNAGANNGQNCFLVGKKFGIRSPIHTTYHPGIKRGKPGGAKGGELLTFF

SEQ ID NO: 799649 - protein, 102 aa, Homo sapiens
TTTTTTTKFAAASTLREDDRQPLRVELESPAKSSVLVVGIVIGVLLLTAAAVGGALLWRRMRSGLPAPWISLRGDDTGVLLPTPGEAQDADLKDVNVIPATA

SEQ ID NO: 799650 - protein, 365 aa, Homo sapiens; identical to SEQ ID NO: 799632

SEQ ID NO: 799651 - protein, 365 aa, Homo sapiens; identical to SEQ ID NO: 799632

SEQ ID NO: 799652 - protein, 225 aa, Homo sapiens
MNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 799653 - protein, 385 aa, Homo sapiens
LPWLIQRTPPNGKPEKILLPPWVSVPLQSSSPPVCSLQLLFLSAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 799654 - protein, 539 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPKARQIFCAWISVYIGSTLRLKARGCEHDTGRYRFAEKKVNIKQKPELLMAVSPVPPFHLTVQQILPTCQRGSSRREKLLCFPEAANVFSAEQTKTKIPAKTHDCPDPPSLKGTWAVMPSPRQLLKSLPFIFFFELGSCSVAQTGVECSGTVIAPCSLGLPSSRDPPASALQVAGTIEPPSMRLKARPSSPGFSVLTCSAFSFYPPELQLRFLRNGLAAGTGQGDFGPNSDGSFHASSSLTVKSGDEHHYCCIVQHAGLAQPLRVELGEVPPGGDAPGFPLPCLTAAPVLPESDLPPHCCHLLESDCLEPHACQCPQNLMACPSQGQLPSVSCCFWPH

SEQ ID NO: 799655 - protein, 403 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKAGILLCRPDWSGVQWHSHSACSLGLPSSRDPPASALQVAGTIEPPSMRLKARPSSPGFSVLTCSAFSFYPPELQLRFLRNGLAAGTGQGDFGPNSDGSFHASSSLTVKSGDEHHYCCIVQHAGLAQPLRVELGEVPPGGDAPGFPLPCLTAAPVLPESDLPPHCCHLLESDCLEPHACQCPQNLMACPSQGQLPSVSCCFWPH

SEQ ID NO: 799656 - protein, 157 aa, Homo sapiens [sequence omitted]

SEQ ID NO: 799657 - protein, 157 aa, Homo sapiens [sequence omitted]

SEQ ID NO: 799658 - protein, 365 aa, Homo sapiens; identical to SEQ ID NO: 799632

SEQ ID NO: 799659 - protein, 216 aa, Homo sapiens
CSQAVARRQEQGRAKGGSAPAIACRSPAGGPGRGGRKTLDVGRPPAAIGALEGRRSRRQAGLFAVAIAWHARLLRLLAPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 799660 - protein, 361 aa, Homo sapiens; identical to SEQ ID NO: 799635

SEQ ID NO: 799661 - protein, 361 aa, Homo sapiens; identical to SEQ ID NO: 799635

SEQ ID NO: 799662 - protein, 206 aa, Homo sapiens
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKGTCTVA

SEQ ID NO: 799663 - protein, 253 aa, Homo sapiens [sequence omitted]

SEQ ID NO: 799664 - protein, 150 aa, Homo sapiens
MRCAEGAWWFSPDGPAGSAASIWPAEGAEGLPGQLGRDRLEVVYSVPDNVPGQNGSRRPLVCKITGKCLSVCSEENAKAGGCSAFPLLLSQLGARMTGREHAHKGPELTTPDSGLPRPPNPALAGFRALAQHSPPLGTSTPSAVLLSAAT

SEQ ID NO: 799665 - protein, 109 aa, Homo sapiens
MRCAEGAWWFSPDGPAGSAASIWPAEGAEGLPGQLGRDRLEVVYSVPDNVPGQNGSRRPLVCKITGKCLSVCSEENAKAGGCSAFPLLLSQLGARMTGREHAHKGPELT

SEQ ID NO: 799666 - protein, 133 aa, Homo sapiens
FVPSRLMLKAMRNFLAPVAVAPQLGTKELGPKSGAQSACWSCEQVRSGNRKQPHKYNGREKEKLVNPHTSVTVTWALRRDFLRGDWHDRDGGYVCPACRRDRDGGYVCPARWRDCDLRPCLGISFQERWVGAA

SEQ ID NO: 799667 - protein, 541 aa, Homo sapiens
MLSPQRVAAAASRGADDAMESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 799668 - protein, 541 aa, Homo sapiens; identical to SEQ ID NO: 799667

SEQ ID NO: 799669 - protein, 593 aa, Homo sapiens
MRTAGRDPVSAGLQFPKDGSTQRPANRARFVPARTRPSPLHPCCFCFEGGGSMLSPQRVAAAASRGADDAMESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 799670 - protein, 604 aa, Homo sapiens
RALEKTSQKVGHADRDGSERGSAWPNGQPRLRPFPASRARFVPARTRPSPLHPCCFCFEGGGSMLSPQRVAAAASRGADDAMESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 799671 - protein, 523 aa, Homo sapiens
MESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 799672 - protein, 32 aa, Homo sapiens
MYDFTYWLTFGDLRSITYGVLIPVKNLALQHR

SEQ ID NO: 799673 - protein, 541 aa, Homo sapiens; identical to SEQ ID NO: 799667

SEQ ID NO: 799674 - protein, 531 aa, Homo sapiens
MLSPQRVAAAASRGADDAMESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSPYAVFNLTRPLEGWS

SEQ ID NO: 799675 - protein, 167 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAATSGALQEASEAYLVGLFEDTNPVCYPCQTCNNYAKRHPASTPHTWRTCLRIHYDGKHFILKKKKKKISLLPVIGSSER

SEQ ID NO: 799676 - protein, 102 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAATSGALQGKMVGGK

SEQ ID NO: 799677 - protein, 167 aa, Homo sapiens; identical to SEQ ID NO: 799675

SEQ ID NO: 799678 - protein, 167 aa, Homo sapiens; identical to SEQ ID NO: 799675

SEQ ID NO: 799679 - protein, 167 aa, Homo sapiens; identical to SEQ ID NO: 799675

SEQ ID NO: 799680 - protein, 246 aa, Homo sapiens
LDEDKEGELQVAGPGQRVQTCWGLGVEVLVVRVSKDLGQLLVRHVGELSEVQEVEVDLGQLLVRHVGELSEVQEVEVDLQRGDAAQRLPPLRDLQEPRCWYWDAPDLLLHRRVAIVPCPLGWDAQRSLRHLSLLERSLAAAPAGVLLFSSRYLRVGRRLCAGAPRGWRGAQEGPDSRWVMTPPSLSNASAASRSPSSSRRRRGVSKEVSVPWLVQSRLPANRPVVKHPGSNWLQKPLARVRPLLEG

SEQ ID NO: 799681 - protein, 167 aa, Homo sapiens; identical to SEQ ID NO: 799675

SEQ ID NO: 799682 - protein, 175 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAATSGALQEASEAYLVGLFEDTNPVCYPCQTCNNYAKRHPASTPHTWRTCLRIHYDGKHFILKKKKKKGLSPQISRNYGMKPWTCQKD

SEQ ID NO: 799683 - protein, 201 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAATSGALQEASEAYLVGLFEDTNPVCYPCQTCNNYAKRHPASTPHTWRTCLRIHYDGKHFILKKKKKKQKTKKKTPRALLMRGGENGCSVKGPWGQRCFPWPPVSLFHKVGTFR

SEQ ID NO: 799684 - protein, 167 aa, Homo sapiens; identical to SEQ ID NO: 799675

SEQ ID NO: 799685 - protein, 167 aa, Homo sapiens; identical to SEQ ID NO: 799675

SEQ ID NO: 799686 - protein, 167 aa, Homo sapiens
GDLEDPSARKSTGGKAPRKQLATKAARKSAPSTGGVKKPHRYRPGTVALREIRRYQKSTELLIRKLPFQRLVREIAQDFKTDLRFQSAATSGALQEASEAYLVGLFEDTNPVCYPCQTCNNYAKRHPASTPHTWRTCLRIHYDGKHFILKKKKKKISLLPVIGSSER

SEQ ID NO: 799687 - protein, 155 aa, Homo sapiens
ENEMFPIIVATKAARKSAPSTGGVKKPHRYRPGTVALREIRRYQKSTELLIRKLPFQRLVREIAQDFKTDLRFQSAATSGALQEASEAYLVGLFEDTNPVCYPCQTCNNYAKRHPASTPHTWRTCLRIHYDGKHFILKKKKKKISLLPVIGSSER

SEQ ID NO: 799688 - protein, 133 aa, Homo sapiens
LLTRLICFTPGTVALREIRRYQKSTELLIRKLPFQRLVREIAQDFKTDLRFQSAATSGALQEASEAYLVGLFEDTNPVCYPCQTCNNYAKRHPASTPHTWRTCLRIHYDGKHFILKKKKKKISLLPVIGSSER

SEQ ID NO: 799689 - protein, 121 aa, Homo sapiens
MARTKQTARKSTGGKAPRKQLATKAARKSAPSTGGVKKPHRYRPGTVALREIRRYQKSTELLIRKLPFQRLVREIAQDLRQVRPIWLAFLKTPTLCAIHAKRVTIMPKDIQLARRIRGERA

SEQ ID NO: 799690 - protein, 112 aa, Homo sapiens
MARTKQTARKSTGGKAPRKQLATKAARKSAPSTGGVKKPHRYRPGTVALREIRRYQKSTELLIRKLPFQRLVTPEGFSTRSMPSDARSHGSPALLLLLLLLLLPVGPPLVVT

SEQ ID NO: 799691 - protein, 167 aa, Homo sapiens; identical to SEQ ID NO: 799675

SEQ ID NO: 799692 - protein, 167 aa, Homo sapiens; identical to SEQ ID NO: 799675

SEQ ID NO: 799693 - protein, 201 aa, Homo sapiens; identical to SEQ ID NO: 799683

SEQ ID NO: 799694 - protein, 144 aa, Homo sapiens
GLMKNNPGPPEVISSTTALAPGTVALREIRRYQKSTELLIRKLPFQRLVREIAQDFKTDLRFQSAATSGALQEASEAYLVGLFEDTNPVCYPCQTCNNYAKRHPASTPHTWRTCLRIHYDGKHFILKKKKKKISLLPVIGSSER

SEQ ID NO: 799695 - protein, 167 aa, Homo sapiens; identical to SEQ ID NO: 799675

SEQ ID NO: 799696 - protein, 167 aa, Homo sapiens; identical to SEQ ID NO: 799675

SEQ ID NO: 799697 - protein, 167 aa, Homo sapiens; identical to SEQ ID NO: 799675

SEQ ID NO: 799698 - protein, 167 aa, Homo sapiens; identical to SEQ ID NO: 799675

SEQ ID NO: 799699 - protein, 167 aa, Homo sapiens; identical to SEQ ID NO: 799675

SEQ ID NO: 799700 - protein, 157 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAATSGALQEASEAYLVGLFEDTNPVCYPCQTCNNYAKRHPASTPHTWRTCLRIHYDGKHFILKKKKKKEK

SEQ ID NO: 799701 - protein, 167 aa, Homo sapiens; identical to SEQ ID NO: 799675

SEQ ID NO: 799702 - protein, 167 aa, Homo sapiens; identical to SEQ ID NO: 799675

SEQ ID NO: 799703 - protein, 180 aa, Homo sapiens
MDSTQVGVFKKANQIGLTCPARKSTGGKAPRKQLATKAARKSAPSTGGVKKPHRYRPGTVALREIRRYQKSTELLIRKLPFQRLVREIAQDFKTDLRFQSAATSGALQEASEAYLVGLFEDTNPVCYPCQTCNNYAKRHPASTPHTWRTCLRIHYDGKHFILKKKKKKISLLPVIGSSER

SEQ ID NO: 799704 - protein, 156 aa, Homo sapiens
MGFFKRVRPLKKNKKGSSFNLMKMVKKPHRYRPGTVALREIRRYQKSTELLIRKLPFQRLVREIAQDFKTDLRFQSAATSGALQEASEAYLVGLFEDTNPVCYPCQTCNNYAKRHPASTPHTWRTCLRIHYDGKHFILKKKKKKISLLPVIGSSER

SEQ ID NO: 799705 - protein, 125 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAATSGALQTPTLCAIHAKRVTIMPKDIQLARRIRGERA

SEQ ID NO: 799706 - protein, 1138 aa, Homo sapiens
ATTGTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 799707 - protein, 1292 aa, Homo sapiens
ATTGTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNIVSGICHLFRALAQDTRQPGKYWGPESPQTVSSWSRPRELPTFVQITSLPMCRDTGAQCQSVANASLGEGEFGDSAESLLRGPAILLTFHPGSILEDRGLILLGELRSGVGFLTYVYICKWSFPVSVSLWLSLSSSTLYLCPFFLQSLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEKRKKKKKEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 799708 - protein, 547 aa, Homo sapiens
ATTGTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHLLLPVPCKPSPSASEKIALRSPLSAQKHW

SEQ ID NO: 799709 - protein, 1088 aa, Homo sapiens
ATTGTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 799710 - protein, 1034 aa, Homo sapiens
FTLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 799711 - protein, 1041 aa, Homo sapiens
MGRWAGPRTFQLLGHWFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 799712 - protein, 1138 aa, Homo sapiens; identical to SEQ ID NO: 799706

SEQ ID NO: 799713 - protein, 1140 aa, Homo sapiens
ATTGTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKVRGQAGKVPWARRWGWREKGWQLLLLGEVCPA

SEQ ID NO: 799714 - protein, 975 aa, Homo sapiens
ATTGTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEMETETEAEALQEKEQDDTAAMLADFIDCPPDDEKPPPPTEPDS

SEQ ID NO: 799715 - protein, 608 aa, Homo sapiens
MWDSDGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 799716 - protein, 426 aa, Homo sapiens
KVGGLGCRIPHEDEEEYFEEEEEEEEEFEEELPAAPGPLPPPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 799717 - protein, 635 aa, Homo sapiens
ATTGTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEAGRGD

SEQ ID NO: 799718 - protein, 404 aa, Homo sapiens
ATTGTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTYFPRACGSLKGKLASFFLSRVDALSPQLQQLACECYSRLPSLGAGFSQGLKHTESWEQELHSLLASLHTLLGALYEGAETAPVQNEGPGVEMLLSSEDGDAHVLLQLRQRFSGLARCLGLMLSSEFGAPVSVPVQEILDFICRTLSVSSKNISLHGDGPCGCCCCPLSTLRPWTCCLHSSSRVEAGSCALGS

SEQ ID NO: 799719 - protein, 89 aa, Homo sapiens
GKGPPPLSPPRFEKKAFCFPPNPLEEETEDGSDKVQPPPETPAEEEMETETEAEALQEKEQDDTAAMLADFIDCPPDDEKPPPPTEPDS

SEQ ID NO: 799720 - protein, 855 aa, Homo sapiens
SVQGSCASAAPVQNEGPGVEMLLSSEDGDAHVLLQLRQRFSGLARCLGLMLSSEFGAPVSVPVQEILDFICRTLSVSSKNISLHGDGPLRLLLLPSIHLEALDLLSALILACGSRLLRFGILIGRLLPQVLNSWSIGRDSLSPGQERPYSTVRTKVYAILELWVQVCGASAGMLQGGASGEALLTHLLSDISPPADALKLRSPRGSPDGSLQTGKPSAPKKLKLDVGEAMAPPSHRKGDSNANSDVCAAALRGLSRTILMCGPLIKEETHRRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 799721 - protein, 683 aa, Homo sapiens [sequence omitted]

SEQ ID NO: 799722 - protein, 594 aa, Homo sapiens
MFPGVLCPFQRLHDLVLPLVMGVQQGEVLGSSPYTSSRCRRELYCLLLALLLAPSPRCPPPLACALQAFSLGQREDSLEVSSFCSEALVTCAALTHPRVPPLQPMGPTCPTPAPVPPPEAPSPFRAPPFHPPGPMPSVGSMPSAGPMPSAGPMPSAGPVPSARPGPPTTANHLGLSVPGLVSVPPRLLPGPENHRAGSNEDPILAPSGTPPPTIPPDETFGGRVPRPAFVHYDKEEASDVEISLESDSDDSVVIVPEGLPPLPPPPPSGATPPPIAPTGPPTASPPVPAKEEPEELPAAPGPLPPPPPPPPPVPGPVTLPPPQLVPEGTPGGGGPPALEEDLTVININSSDEEEEEEEEEEEEEEEEEEEEEDFEEEEEDEEEYFEEEEEEEEEFEEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 799723 - protein, 323 aa, Homo sapiens
KVGGLGCRIPHEDEEEYFEEEEEEEEEFEEELPAAPGPLPPPPPTIPPDETFGGRVPRPAFVHYDKEEASDVEISLESDSDDSVVIVPEGLPPLPPPPPSGATPPPIAPTGPPTASPPVPAKEEPEEFEEEEGELEEEEEEEDEEEEEELEEVEDLEFGTAGGEVEEGAPPPPTLPPALPPPESPPKVQPEPEPEPGLLLEVEEPGTEEERGADTAPTLAPEALPSQGEVEREGESPAAGPPPQELVEEEPSAPPTLLEEETEDGSDKVQPPPETPAEEEMETETEAEALQEKEQDDTAAMLADFIDCPPDDEKPPPPTEPDS

SEQ ID NO: 799724 - protein, 113 aa, Homo sapiens
ATTGTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTR

SEQ ID NO: 799725 - protein, 245 aa, Homo sapiens
MRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 799726 - protein, 213 aa, Homo sapiens
MRTSAEYFRLALSKLQSCDLFDEFDKMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 799727 - protein, 331 aa, Homo sapiens
MRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 799728 - protein, 331 aa, Homo sapiens; identical to SEQ ID NO: 799727

SEQ ID NO: 799729 - protein, 331 aa, Homo sapiens; identical to SEQ ID NO: 799727

SEQ ID NO: 799730 - protein, 331 aa, Homo sapiens; identical to SEQ ID NO: 799727

SEQ ID NO: 799731 - protein, 187 aa, Homo sapiens
MNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 799732 - protein, 266 aa, Homo sapiens
MRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAIFT

SEQ ID NO: 799733 - protein, 32 aa, Homo sapiens
RNYFLHLLCRHVIHVSSGALLYSNLELAGKPE

SEQ ID NO: 799734 - protein, 431 aa, Homo sapiens
GGSLRLRAGLLPPLLPRQIRGEGIVPAPPLARATFLWFLPASGFCGPMWQAPRERQQPAGAAAPQVSEPGAPLRSSLLGLGGSLLPAGFAAGLHCPGEPAMRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 799735 - protein, 373 aa, Homo sapiens
LVRSEFWDPPPFLVPPFAVIFRSRRPARARGWCPPRPKGEPAMRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDVIIRMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 799736 - protein, 331 aa, Homo sapiens; identical to SEQ ID NO: 799727

SEQ ID NO: 799737 - protein, 331 aa, Homo sapiens; identical to SEQ ID NO: 799727

SEQ ID NO: 799738 - protein, 245 aa, Homo sapiens; identical to SEQ ID NO: 799725

SEQ ID NO: 799739 - protein, 200 aa, Homo sapiens
QAGGEWWNWKLKRMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 799740 - protein, 561 aa, Homo sapiens
MGARTPLPSFWVSFFAETGILFPGGTPWPMGSQHSKQHRKPGPLKRGHRRDRRTTRRKYWKEGREIARVLDDEGRNLRQQKLDRQRALLEQKQKKKRQEPLMVQANADGRPRSRRARQSEEQAPLVESYLSSSGSTSYQVQEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVREAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVSIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 799741 - protein, 426 aa, Homo sapiens
MVQANADGRPRSRRARQSEEQAPLVESYLSSSGSTSYQVQEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVREAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVSIRPRNEHETLLARWQNKNTESIIELQNKTPVWNDDTQSYVLNFHGRVTQASVKNFQIIHGNDQTQRCDTILI

SEQ ID NO: 799742 - protein, 506 aa, Homo sapiens
MTSKPHSDWIPYSVLDDEGRNLRQQKLDRQRALLEQKQKKKRQEPLMVQANADGRPRSRRARQSEEQAPLVESYLSSSGSTSYQVQEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVREAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVSIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 799743 - protein, 81 aa, Homo sapiens
MVQANADGRPRSRRARQSEEQAPLVESYLSSSGSTSYQGIPCLLPNPVTASGSPSLPAHLGRYGLVLTGDAQAVYGFQPRQ

SEQ ID NO: 799744 - protein, 66 aa, Homo sapiens
SRAAAYYYYTFAAASTASLESSSHGPTLPYGRGPQQGPQSDQEREQAQAQPTPRASGPNTPSSCGT

SEQ ID NO: 799745 - protein, 130 aa, Homo sapiens
CLVPAREFMGWRAAAMALRYPMAVGLNKGHKVTKNVSKPRHSRRRGRLDQTHQVRAGHDSGGVWLCPVRAARHGVTEGLQGQTGPQIYQEKGGDAHPRQEEAGGAEQRTGRHEESCCQERLSPSPALSLK

SEQ ID NO: 799746 - protein, 131 aa, Homo sapiens
AAAAIGHEGRLWRAAAMALRYPMAVGLNKGHKVTKNVSKPRHSRRRGRLDQTHQVRAGHDSGGVWLCPVRAARHGVTEGLQGQTGPQIYQEKGGDAHPRQEEAGGAEQRTGRHEESCCQERLSPSPALSLK

SEQ ID NO: 799747 - protein, 130 aa, Homo sapiens
RLVRGWFAAFWRAAAMALRYPMAVGLNKGHKVTKNVSKPRHSRRRGRLDQTHQVRAGHDSGGVWLCPVRAARHGVTEGLQGQTGPQIYQEKGGDAHPRQEEAGGAEQRTGRHEESCCQERLSPSPALSLK

SEQ ID NO: 799748 - protein, 131 aa, Homo sapiens
AGTGPECRDRLWRAAAMALRYPMAVGLNKGHKVTKNVSKPRHSRRRGRLDQTHQVRAGHDSGGVWLCPVRAARHGVTEGLQGQTGPQIYQEKGGDAHPRQEEAGGAEQRTGRHEESCCQERLSPSPALSLK

SEQ ID NO: 799749 - protein, 63 aa, Homo sapiens
MASPEAPESVVQFALDKLLDLPGGLDYRVLTTFTRYGRTRARSPSHSLLMVNFVSSCTDFPLA

SEQ ID NO: 799750 - protein, 102 aa, Homo sapiens
MLRELRSRMLSATAGKTPAARGSACRSCLSGLRLLSRVDIPEFRAAPALPPRPSLESSSHGPTLPYGRGPQQGPQSDQEREQAQAQPTPRASGPNTPSSCGT

SEQ ID NO: 799751 - protein, 115 aa, Homo sapiens
MALRYPMAVGLNKGHKVTKNVSKPRHSRRRGRLDQTHQVRAGHDSGGVWLCPVRAARHGVTEGLQGQTGPQIYQEKGGDAHPRQEEAGGAEQRTGRHEESCCQERLSPSPALSLK

SEQ ID NO: 799752 - protein, 115 aa, Homo sapiens; identical to SEQ ID NO: 799751

SEQ ID NO: 799753 - protein, 211 aa, Homo sapiens
MKVLLLTGLGALFFAYYWDDNFDPASLQGARVLLTGANAGVGEELAYHYARLGSHLVLTAHTEALLQKGRPEIGGVGIRTHFTGRGRRAAIATSTGSDSSSRARRSKRACSGSSVAHAQRNGGEDSSRQGERVPFLPLWPAPPEPSRYPGVPRGASPSATAVSGEQQVSGFPHCRYPPPSGLPGPLCRLEDGWLWRARLKEPGRGALGLGN

SEQ ID NO: 799754 - protein, 130 aa, Homo sapiens; identical to SEQ ID NO: 799745

SEQ ID NO: 799755 - protein, 115 aa, Homo sapiens; identical to SEQ ID NO: 799751

SEQ ID NO: 799756 - protein, 211 aa, Homo sapiens; identical to SEQ ID NO: 799753

SEQ ID NO: 799757 - protein, 199 aa, Homo sapiens
MASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 799758 - protein, 185 aa, Homo sapiens
MTTSTGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 799759 - protein, 241 aa, Homo sapiens
MASPEAPESVVQFALDKLGGLDYLVLNHIGGAPAGTRARSPQATRWLMQVNFVSYVQLTSRALPSLTDSKGSLVVVSSLLGACTRPRLCGTGSGELMRVSLEGLGRLPGRGGATQPLPSAPPGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 799760 - protein, 180 aa, Homo sapiens
MQVNFVSYVQLTSRALPSLTDSKGSLVVVSSLLGRVPTSFSTPYSAAKFALDGFFGSLRRELDVQDVNVAITMCVLGLRDRASAAEAVRGGPDKLGAGLGAMAQPQPQSPPCPPVPRGVTRVKAAPGPKAALAVIRGGATRAAGVFYPWRFRLLCLLRRWLPRPRAWFIRQELNVTAAAA

SEQ ID NO: 799761 - protein, 180 aa, Homo sapiens; identical to SEQ ID NO: 799760

SEQ ID NO: 799762 - protein, 93 aa, Homo sapiens
YVRLGSEAWVAISLQLVVASEAEGAGTRGSGPRELSRYSPPPLLPVAVRSHGPTLPYGRGPQQGPQSDQEREQAQAQPTPRASGPNTPSSCGT

SEQ ID NO: 799763 - protein, 115 aa, Homo sapiens; identical to SEQ ID NO: 799751

SEQ ID NO: 799764 - protein, 140 aa, Homo sapiens
KQCYQRRVPITAGAFRHGRLWRAAAMALRYPMAVGLNKGHKVTKNVSKPRHSRRRGRLDQTHQVRAGHDSGGVWLCPVRAARHGVTEGLQGQTGPQIYQEKGGDAHPRQEEAGGAEQRTGRHEESCCQERLSPSPALSLK

SEQ ID NO: 799765 - protein, 131 aa, Homo sapiens
PPPPAFRHGRLWRAAAMALRYPMAVGLNKGHKVTKNVSKPRHSRRRGRLDQTHQVRAGHDSGGVWLCPVRAARHGVTEGLQGQTGPQIYQEKGGDAHPRQEEAGGAEQRTGRHEESCCQERLSPSPALSLK

SEQ ID NO: 799766 - protein, 106 aa, Homo sapiens
MKVLLLTGLGALFFAYYWDDNFDPASLQGARVLLTGANAGVGEELAYHYARLGSHLVLTAHTEALLQKEARWLTLVVSTLGGRGKWITWGQEFKTSLANMAKPGLY

SEQ ID NO: 799767 - protein, 105 aa, Homo sapiens
AAAAIGHEGRLWRAAAMALRYPMAVGLNKGHKVTKNVSKPRHSRRRGRLDQTHQVRAGHDSGGVWLCPVRAARHGVTEGLQGQTGPQIYQEKVLAAMRKAAAKKD

SEQ ID NO: 799768 - protein, 210 aa, Homo sapiens
MKVLLLTGLGALFFAYYWDDNFDPASLQGARVLLTGANAGVGEELAYHYARLGSHLVLTAHTEALLQKGRPEIGGVGIRTHFTGRGRRAAIATSTGSDSSSRARRSKRACSGSSVAHAQRNGGEDSSRQGERVPFFLSGLRLLSRVDIPEFRAAPALPPRPSLESSSHGPTLPYGRGPQQGPQSDQEREQAQAQPTPRASGPNTPSSCGT

SEQ ID NO: 799769 - protein, 115 aa, Homo sapiens; identical to SEQ ID NO: 799751

SEQ ID NO: 799770 - protein, 211 aa, Homo sapiens; identical to SEQ ID NO: 799753

SEQ ID NO: 799771 - protein, 115 aa, Homo sapiens; identical to SEQ ID NO: 799751

SEQ ID NO: 799772 - protein, 152 aa, Homo sapiens
MQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 799773 - protein, 152 aa, Homo sapiens; identical to SEQ ID NO: 799772

SEQ ID NO: 799774 - protein, 223 aa, Homo sapiens
MTTSTVVGNCRKLGAPKVFYIAADMASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRGVTRVKAAPGPKAALAVIRGGATRAAGVFYPWRFRLLCLLRRWLPRPRAWFIRQELNVTAAAA

SEQ ID NO: 799775 - protein, 173 aa, Homo sapiens
MASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVAQRHGRGSLSTGGCPSSPRRQCSSLQLSLEPEHSQRHP

SEQ ID NO: 799776 - protein, 104 aa, Homo sapiens
MPATSVPCPSAGPHRTMKVLLLTGLGALFFAYYWDDNFDPASLQGARVLLTGANAGVGEELAYHYARLGSHLVLTAHTEALLQKEARWLTLVVSTLGGRGKWIT

SEQ ID NO: 799777 - protein, 293 aa, Homo sapiens
MSRIPLGKVLLRNVIRHTDAHNKIQEESDMWKIRELEKQMEDAYRGTKRKMLPSSSSRMRSDGFDEESQRYYWRPKNEISGTLEDDFLKAKSWNKKFYDYEANMPDRWGHSGYKELYPEEFETDSSDQQDITNGKKTSPQVKSSTHESRKHKKSKKSHKKKQKKRSHKKQKKSKKEATDITADSSSEFSEETGASGTRKGKQPHKRKKKSRKKSLKKPALFLEAESNTSHSDDSASSSSEESEERDTKKTKRKKREKKAHTSVANNEIQERTNKRTNWKVATDERSAESSEDD

SEQ ID NO: 799778 - protein, 293 aa, Homo sapiens; identical to SEQ ID NO: 799777

SEQ ID NO: 799779 - protein, 293 aa, Homo sapiens; identical to SEQ ID NO: 799777

SEQ ID NO: 799780 - protein, 200 aa, Homo sapiens
MHCFNNTCDVSYYRWGHSGYKELYPEEFETDSSDQQDITNGKKTSPQVKSSTHESRKHKKSKKSHKKKQKKRSHKKQKKSKKEATDITADSSSEFSEETGASGTRKGKQPHKRKKKSRKKSLKKPALFLEAESNTSHSDDSASSSSEESEERDTKKTKRKKREKKAHTSVANNEIQERTNKRTNWKVATDERSAESSEDD

SEQ ID NO: 799781 - protein, 293 aa, Homo sapiens; identical to SEQ ID NO: 799777

SEQ ID NO: 799782 - protein, 293 aa, Homo sapiens; identical to SEQ ID NO: 799777

SEQ ID NO: 799783 - protein, 226 aa, Homo sapiens
MSRIPLGKVLLRNVIRHTDAHNKIQEESDMWKIRELEKQMEDAYRGTKRKMLPSSSSRMRSDGFDEESQRYYWRPKNEISGTLEDDFLKAKSWNKKFYDYEANMPDRWGHSGYKELYPEEFETDSSDQQDITNGKKTSPQVKSSTHESRKHKKSKKSHKKKQKKRSHKKQKKSKKEATDITADSSSEFSEETGASGTRKGKQPHKRKNRMKKVRGTAKANVGAGKK

SEQ ID NO: 799784 - protein, 47 aa, Homo sapiens
MATLMLAPSHPVYHTCRTEQREEVVCSPMSSPDSSGIGHPGSPGGTG

SEQ ID NO: 799785 - protein, 132 aa, Homo sapiens
MALDLGSLQSPPPRFKRFSCLRLLSSWDYRHAPPCPANFVFLVETGFLHVGQADLKLPTSGDPPASASQSVGIIGMRHHARLIFVFFVKTGFCHVTQAGFKLLGSSDPPASASQTAGITSVGNCTRLHLGYS

SEQ ID NO: 799786 - protein, 111 aa, Homo sapiens
MSHKWNHTVSGIGGFLVSLTSRMTPWTLAVSVTALKVGASGSLFLLMFGCVRSFFLLVGSWSRWLRSEAADFRDFISLSAMDTDGFTPSCILRTMIKFQTLGSFCVPRSRA

SEQ ID NO: 799787 - protein, 85 aa, Homo sapiens
QPRKGLPQCSGGLKGSSSAAKLGAQAEEVPRASEGSEDCQHAVTSQYNFISLSAMDTDGFTPSCILRTMIKFQTLGSFCVPRSRA

SEQ ID NO: 799788 - protein, 272 aa, Homo sapiens
LGTDDPAPLPCTASTSLAVLTVSRSSHQEMGFHHVGQAGLELLNSSDPPTLASQSTGITGVSHRAWREGEFELGLGEWGLEAPLPWRARSQEELWGGKNGGGGTAPDPPAPQVSSHRHQVHQAVLARLEVCVREGVGWHQQLLILEMRMMGAHPLSSQEPHPHPRPPLSPAAPERCISEGGEEMGARCYRLAPASPRPLACHPQPCGFSCGLLWLESTLLATPRSLGRDPSPVRMVEKKSSQKRQRMGAATTWFTAPEWIFLSSLAGRLFWS

SEQ ID NO: 799789 - protein, 473 aa, Homo sapiens
NSCCWLFLLRPFPETDSSFGEQKAPAMQPWHGKAMQRASEAGATAPKASARNARGAPMDPNESPAAPEAALPKAGKFGPARKSGSRQKKSAPDTQERPPVRATGARAKKAPQRAQDTQPSDATSAPGAEGLEPPAAREPALSRAGSCRQRGARCSTKPRPPPGPWDVPSPGLPVSAPILVRRDAAPGASKLRAVLEKLKLSRDDISTAAGMVKGVVDHLLLRLKCDSAFRGVGLLNTGSYYEHVKISAPNEFDVMFKLEVPRIQLEEYSNTRAYYFVKFKRNPKENPLSQFLEGEILSASKMLSKFRKIIKEEINDIKDTDVIMKRKRGGSPAVTLLISEKISVDITLALESKSSWPASTQEGLRIQNWLSAKVRKQLRLKPFYLVPKHAKEGNGFQEETWRLSFSHIEKEILNNHGKSKTCCENKEEKCCRKDCLKLMKYLLEQLKERFKDKKHLDKFSSYHVKTAFFHRLY

SEQ ID NO: 799790 - protein, 548 aa, Homo sapiens
NSCCWLFLLRPFPETDSSFGEQKAPAMQPWHGKAMQRASEAGATAPKASARNARGAPMDPNESPAAPEAALPKAGKFGPARKSGSRQKKSAPDTQERPPVRATGARAKKAPQRAQDTQPSDATSAPGAEGLEPPAAREPALSRAGSCRQRGARCSTKPRPPPGPWDVPSPGLPVSAPILVRRDAAPGASKLRAVLEKLKLSRDDISTAAGMVKGVVDHLLLRLKCDSAFRGVGLLNTGSYYEHVKISAPNEFDVMFKLEVPRIQLEEYSNTRAYYFVKFKRNPKENPLSQFLEGEILSASKMLSKFRKIIKEEINDIKDTDVIMKRKRGGSPAVTLLISEKISVDITLALESKSSWPASTQEGLRIQNWLSAKVRKQLRLKPFYLVPKHAKEGNGFQEETWRLSFSHIEKEILNNHGKSKTCCENKEEKCCRKDCLKLMKYLLEQLKERFKDKKHLDKFSSYHVKTAFFHVCTQNPQDSQWDRKDLGLCFDNCVTYFLQCLRTEKLENYFIPEFNLFSSNLIDKRSKEFLTKQIEYERNNEFPVFDEF

SEQ ID NO: 799791 - protein, 408 aa, Homo sapiens
NSCCWLFLLRPFPETDSSFGEQKAPAMQPWHGKAMQRASEAGATAPKASARNARGAPMDPNESPAAPEAALPKAGKFGPARKSGSRQKKSAPDTQERPPVRATGARAKKAPQRAQDTQPSDATSAPGAEGLEPPAAREPALSRAGSCRQRGARCSTKPRPPPGPWDVPSPGLPVSAPILVRRDAAPGASKLRAVLEKLKLSRDDISTAAGMVKGVVDHLLLRLKCDSAFRGVGLLNTGSYYEHVKISAPNEFDVMFKLEVPRIQLEEYSNTRAYYFVKFKRNPKENPLSQFLEGEILSASKMLSKFRKIIKEEINDIKDTDVIMKRKRGGSPAVTLLISEKISVDITLALESKSSWPASTQEGLRIQNWLSAKVRKQLRLKPFYLVPKHAKEGNGFQGILNIKVNLKK

SEQ ID NO: 799792 - protein, 174 aa, Homo sapiens
MTRTQKGKTFLPHCFYQSLPPRLGWGMILNYSKLKGKEECASVSSVPMVFFSSQYRLHRKSQYLKMAAANLTFSQEVVWQRGLPSIPYSQYSFDHLYNTNDIIHTPQIRKARPQKPVSFKFLGSSSPLTGDTSLAVKTESSANPEKKLKKSKPASTVREAPRPLIHHPCMHPDM

SEQ ID NO: 799793 - protein, 551 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFASPYAGAGFPPTFAIPQAAAGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 799794 - protein, 557 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 799795 - protein, 367 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFQAFPFRTSTAPWPPWPSPRRRRQLRRQVGSPSRAWRGQEILYCWSATSTQRESHPKASLFFSASTVTCSA

SEQ ID NO: 799796 - protein, 441 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGIQTLGLGSPATACPHHLPRQLRIHGGSLGGLGTRVPGQGPFPGEGTPRPQSRLGQGSGRTGLWRPTCGRRQPEAANRTVFVVWFPSSTSGRARGPPVVGGMSLVVEFEWPGKRAARG

SEQ ID NO: 799797 - protein, 511 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGIQTLGLGSPATACPHHLPRQLRIHGGSLGGLGTRVPGQGPFPGEGTPRPQSRLSSMTGGGTCVRGRPPASLLGPGPGRPSAGRGRSSACRPAAASSAWRHGRACAVVPGRALLAEGPVSVLAEPELFCAVGGAHADEPRPGPARAVRRGGRWCRSRRVAVRGSGDPTGTQGRARARAASRAARLLGA

SEQ ID NO: 799798 - protein, 367 aa, Homo sapiens; identical to SEQ ID NO: 799795

SEQ ID NO: 799799 - protein, 557 aa, Homo sapiens; identical to SEQ ID NO: 799794

SEQ ID NO: 799800 - protein, 356 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFQAFPFRTSTAPWPPWPSPRRRRQLRRQVGSPSRAWRGQEILYCWSATSTQRASTVTCSA

SEQ ID NO: 799801 - protein, 546 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGLSVPNVHGALAPLAIPSAAAAAAAAGRIAIPGLAGAGNSVLLVSNLNPEGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 799802 - protein, 527 aa, Homo sapiens
MSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 799803 - protein, 557 aa, Homo sapiens; identical to SEQ ID NO: 799794

SEQ ID NO: 799804 - protein, 557 aa, Homo sapiens; identical to SEQ ID NO: 799794

SEQ ID NO: 799805 - protein, 557 aa, Homo sapiens; identical to SEQ ID NO: 799794

SEQ ID NO: 799806 - protein, 557 aa, Homo sapiens; identical to SEQ ID NO: 799794

SEQ ID NO: 799807 - protein, 441 aa, Homo sapiens; identical to SEQ ID NO: 799796

SEQ ID NO: 799808 - protein, 441 aa, Homo sapiens; identical to SEQ ID NO: 799796

SEQ ID NO: 799809 - protein, 203 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 799810 - protein, 557 aa, Homo sapiens; identical to SEQ ID NO: 799794

SEQ ID NO: 799811 - protein, 441 aa, Homo sapiens; identical to SEQ ID NO: 799796

SEQ ID NO: 799812 - protein, 441 aa, Homo sapiens; identical to SEQ ID NO: 799796

SEQ ID NO: 799813 - protein, 265 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALRREAARQVPRLTEFTSAGLLCRAWLGELSVFSSLWLENWM

SEQ ID NO: 799814 - protein, 150 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSSCLLCALSNRPRVLSRGLS

SEQ ID NO: 799815 - protein, 102 aa, Homo sapiens
AAAPRVCPPPRGRRGLSRDPRGRRHGEGPSRLSGRGSLSGRLCWAGFPWERWEPPPERPCPAERFLREALPGNRKRERLEMFRILSVFLRSFSWVQSLLKVC

SEQ ID NO: 799816 - protein, 557 aa, Homo sapiens; identical to SEQ ID NO: 799794

SEQ ID NO: 799817 - protein, 367 aa, Homo sapiens; identical to SEQ ID NO: 799795

SEQ ID NO: 799818 - protein, 126 aa, Homo sapiens
VGLADLVPPVASAHGDDGELGQDDGPTDGGHLLGALNTQTDVAIVVPDSNKCLEPGALAGTGLLLHWHNLQNLILEEAVFYGDTNVYFANSNSRLSIVTAEPQGTPRTFRCLTRWLVTRREPIKTV

SEQ ID NO: 799819 - protein, 557 aa, Homo sapiens; identical to SEQ ID NO: 799794

SEQ ID NO: 799820 - protein, 441 aa, Homo sapiens; identical to SEQ ID NO: 799796

SEQ ID NO: 799821 - protein, 441 aa, Homo sapiens; identical to SEQ ID NO: 799796

SEQ ID NO: 799822 - protein, 367 aa, Homo sapiens; identical to SEQ ID NO: 799795

SEQ ID NO: 799823 - protein, 461 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGRPFRSERPRRPGPPGHPLGGGGSCGGRSDRHPGPGGGRKFCIAGQQPQPRGTWAFPPRRRSSRKSEQGMLCSGSGPGAAPPLAVSAPLPWQPLCCSAETLLFQDGLSFPLFLNSHLGSRFLLHDTQNELFFGYPKAI

SEQ ID NO: 799824 - protein, 261 aa, Homo sapiens [sequence omitted]

SEQ ID NO: 799825 - protein, 151 aa, Homo sapiens
MADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 799826 - protein, 203 aa, Homo sapiens; identical to SEQ ID NO: 799809

SEQ ID NO: 799827 - protein, 133 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAAQALIDLHNHDLGENHHLRVSFSKSTI

SEQ ID NO: 799828 - protein, 441 aa, Homo sapiens; identical to SEQ ID NO: 799796

SEQ ID NO: 799829 - protein, 441 aa, Homo sapiens; identical to SEQ ID NO: 799796

SEQ ID NO: 799830 - protein, 458 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGLSVPNVHGALAPLAIPSAAAAAAAAGRIAIPGLAGAGNSVLLVSNLNPEVTPERGRGPGRLLQDHAAGARRPRLRHPNPSPLIKSRDSPFTPPPGPSLLPPGGLPAAPAAELVDIISVLYTLQLQTSVPSNISS

SEQ ID NO: 799831 - protein, 557 aa, Homo sapiens; identical to SEQ ID NO: 799794

SEQ ID NO: 799832 - protein, 441 aa, Homo sapiens; identical to SEQ ID NO: 799796

SEQ ID NO: 799833 - protein, 441 aa, Homo sapiens; identical to SEQ ID NO: 799796

SEQ ID NO: 799834 - protein, 149 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNRPLTGT

SEQ ID NO: 799835 - protein, 111 aa, Homo sapiens
MQLYLYSMSTAIMGLDEQARTVEREEKKENSGAIRSDRCVKASFQQGLANNISFYLCPPGYRSTYAQILFCLCRPETARPTPSPPLPPPQPTQREEDENEDLYDDPHPLNE

SEQ ID NO: 799836 - protein, 244 aa, Homo sapiens
MKERRASQKLSSKSIMDPNQNVKCKIVVVGDSQCGKTALLHVFAKDCFPENYVPTVFENYTASFEIDTQRIELSLWDTSGSPYYDNVRPLSYPDSDAVLICFDISRPETLDSVLKKWKGEIQEFCPNTKMLLVGCKSDLRTDVSTLVELSNHRQTPVSYDQGANMAKQIGAATYIECSALQSENSVRDIFHVATLACVNKTNKNVKRNKSQRATKRISHMPSRPELSAVATDLRKDKAKSCTVM

SEQ ID NO: 799837 - protein, 93 aa, Homo sapiens
KIPVPRENKATSMKERRASQKLSSKSIMDPNQNVKCKIVVVGDSQCGKTALLHVFAKDCFPEVSVAGRGFHEGVGQWDPSPEVGLPAFIRFPL

SEQ ID NO: 799838 - protein, 244 aa, Homo sapiens; identical to SEQ ID NO: 799836

SEQ ID NO: 799839 - protein, 146 aa, Homo sapiens [sequence omitted]

SEQ ID NO: 799840 - protein, 163 aa, Homo sapiens
ANACSFLIAQPIYCLLQEAFLNPPVSKGEPTAKKGLVKSSGVHGHQDWEQAGWLHPNPPAFRRRAHDHREFSLHVHPFKGLGFKGSSFHRIIPQFICQGSDFTNHGGTRGLRRHGTKCPMAHLALMEASKGQDQHPLLRRKERAQQKQGESAITSQPRSWKLT

SEQ ID NO: 799841 - protein, 104 aa, Homo sapiens
MTQSWGAREKVSPIHVLLPEPQGPNPSSSPAGPSPPRGLNPPRNPRRKRLGRSSGPTTPIFTLCPLPSRPSPAGPPLPTPPRAAVVANAGRSQLPCGNADSLVG

SEQ ID NO: 799842 - protein, 119 aa, Homo sapiens
MDIKIGNKPAGCIQTLLRSDVVPMTTENFLYMCTHLKDSASREAASTALSPSSFARAVISQTTVAPGVCAGMALSVPWHIWPSWRPQKGRTSTLFYGGRNGHSRNKESQQLPASQGPGS

SEQ ID NO: 799843 - protein, 119 aa, Homo sapiens; identical to SEQ ID NO: 799842

SEQ ID NO: 799844 - protein, 110 aa, Homo sapiens
MDIKIGNKPAGCIQTLLRSDVVPMTTENFLYMCTHLKDSASREAASTALSPSSFARAVISQTTVAPGVCAGMALSVPWHIWPSWRPQKGRTSTLFYGGRNGHSRYMMWSN

SEQ ID NO: 799845 - protein, 544 aa, Homo sapiens
AASPPPPPPDAGAAFWKVREGSEGLPLLHCGRPESGSIRPSRANPDTAEFAMPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGRKNCRH

SEQ ID NO: 799846 - protein, 543 aa, Homo sapiens
HGSYSPAYVPRLGGGKVREGSEGLPLLHCGRPESGSIRPSRANPDTAEFAMPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGRKNCRH

SEQ ID NO: 799847 - protein, 550 aa, Homo sapiens
KLGTRLRLIGRGLPPVRRSAFWKVREGSEGLPLLHCGRPESGSIRPSRANPDTAEFAMPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGRKNCRH

SEQ ID NO: 799848 - protein, 525 aa, Homo sapiens
VTCSTSVQFASVWPESGSIRPSRANPDTAEFAMPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGRKNCRH

SEQ ID NO: 799849 - protein, 544 aa, Homo sapiens; identical to SEQ ID NO: 799845

SEQ ID NO: 799850 - protein, 544 aa, Homo sapiens; identical to SEQ ID NO: 799845

SEQ ID NO: 799851 - protein, 544 aa, Homo sapiens; identical to SEQ ID NO: 799845

SEQ ID NO: 799852 - protein, 544 aa, Homo sapiens; identical to SEQ ID NO: 799845

SEQ ID NO: 799853 - protein, 544 aa, Homo sapiens; identical to SEQ ID NO: 799845

SEQ ID NO: 799854 - protein, 544 aa, Homo sapiens; identical to SEQ ID NO: 799845

SEQ ID NO: 799855 - protein, 544 aa, Homo sapiens; identical to SEQ ID NO: 799845

SEQ ID NO: 799856 - protein, 544 aa, Homo sapiens; identical to SEQ ID NO: 799845

SEQ ID NO: 799857 - protein, 544 aa, Homo sapiens; identical to SEQ ID NO: 799845

SEQ ID NO: 799858 - protein, 507 aa, Homo sapiens
MNSVHVSHNVRLTLGSLDLVVAWRSAPVVTGSHQSCDQLQSTRPKNPAFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGRKNCRH

SEQ ID NO: 799859 - protein, 544 aa, Homo sapiens; identical to SEQ ID NO: 799845

SEQ ID NO: 799860 - protein, 343 aa, Homo sapiens
MSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGRKNCRH

SEQ ID NO: 799861 - protein, 544 aa, Homo sapiens; identical to SEQ ID NO: 799845

SEQ ID NO: 799862 - protein, 174 aa, Homo sapiens
MKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGRKNCRH

SEQ ID NO: 799863 - protein, 544 aa, Homo sapiens; identical to SEQ ID NO: 799845

SEQ ID NO: 799864 - protein, 174 aa, Homo sapiens; identical to SEQ ID NO: 799862

SEQ ID NO: 799865 - protein, 505 aa, Homo sapiens
AASPPPPPPDAGAAFWKVREGSEGLPLLHCGRPESGSIRPSRANPDTAEFAMPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDAHVYRGKAHKGLWGRGPKMSCPIRDSKDGWTKGGCSGDPTGKGNLRK

SEQ ID NO: 799866 - protein, 336 aa, Homo sapiens
AASPPPPPPDAGAAFWKVREGSEGLPLLHCGRPESGSIRPSRANPDTAEFAMPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRMFRYQLDSIMS

SEQ ID NO: 799867 - protein, 70 aa, Homo sapiens
GRLLLLNSRPRRRKCRPESHFYSNRTKKPACPGEKKLQALMSEKGGISNILEELVVQPLLVSSQCSDSCN

SEQ ID NO: 799868 - protein, 544 aa, Homo sapiens; identical to SEQ ID NO: 799845

SEQ ID NO: 799869 - protein, 544 aa, Homo sapiens; identical to SEQ ID NO: 799845

SEQ ID NO: 799870 - protein, 526 aa, Homo sapiens
AASPPPPPPDAGAAFWKVREGSEGLPLLHCGRPESGSIRPSRANPDTAEFAMPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGRKNCRH

SEQ ID NO: 799871 - protein, 410 aa, Homo sapiens
GRVGRPTRPELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGRKNCRH

SEQ ID NO: 799872 - protein, 526 aa, Homo sapiens
AASPPPPPPDAGAAFWKVREGSEGLPLLHCGRPESGSIRPSRANPDTAEFAMPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALGETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGRKNCRH

SEQ ID NO: 799873 - protein, 234 aa, Homo sapiens
MDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGRKNCRH

SEQ ID NO: 799874 - protein, 200 aa, Homo sapiens
LAGLTLFINHRYRDALSDLALHFLNKMKIMVIKDIEREDIEFICKTIGTKPVAHIDQFTADMLGSAELAEEVNLNGSGKLLKITGCASPGKTVTIVVRGSNKLVIEEAERSIHDALCVIRCLVKKRALIAGGGAPEIELALRLTEYSRTLSGMESYCVRAFADAMEVIPSTLAENAGLNPISTVTELRNRHAQGRKNCRH

SEQ ID NO: 799875 - protein, 452 aa, Homo sapiens
AASPPPPPPDAGAAFWKVREGSEGLPLLHCGRPESGSIRPSRANPDTAEFAMPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKGIHPTIISESFQKALEKGIEILTDMSRPVELSDRETLLNSATTSLNSKVVSQYSSLLSPMSVNAVMKVIDPATATSVDLRDIKIVKKLGGTIDDCELVEGLVLTQKVSNSGITRVEKAKIGLIQFCLSAPKTDMDNQIVVSDYAQMDRVLREERAYILNLVKQIKKTGCNVLLIQKSILRDALSDLALHFLNKMKIMVIKDIEREDIEFICKTIGTKPVAHIDQFTADMLGSAELAEEVNLNGSGKLLKGGISNILEELVVQPLLVSSQCSDSCN

SEQ ID NO: 799876 - protein, 182 aa, Homo sapiens
AASPPPPPPDAGAAFWKVREGSEGLPLLHCGRPESGSIRPSRANPDTAEFAMPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKRFVIF

SEQ ID NO: 799877 - protein, 193 aa, Homo sapiens
AASPPPPPPDAGAAFWKVREGSEGLPLLHCGRPESGSIRPSRANPDTAEFAMPENVAPRSGATAGAAGGRGKGAYQDRDKPAQIRFSNISAAKAVADAIRTSLGPKGMDKMIQDGKGDVTITNDGATILKQMQVLHPAARMLVELSKAQDIEAGDGTTSVVIIAGSLLDSCTKLLQKDSPPYSEDSEAWKGLN

SEQ ID NO: 799878 - protein, 145 aa, Homo sapiens
AASPPPPPPDAGAAFWKVREGSEGLPLLHCGRPESGSIRPSRANPDTAEFAMPENVAPRSGATAGAAGGRGKGAYQDRDKPAQIRFSNISAAKAVADAIRTSLGPKGMDKMIQDGKGDVTITNDGATILKQMQVLHPAARMLVEV

SEQ ID NO: 799879 - protein, 554 aa, Homo sapiens
MSADGGGIQDTQDKETPPEVPDRGHPHQEMPSKLGEAVPSGDTQESLHIKMEPEEPHSEGASQEDGAQGAWGWAPLSHGSKEKALFLPGGALPSPRIPVLSREGRTRDRQMAAALLTAWSQMPVTFEDVALYLSREEWGRLDHTQQNFYRDVLQKKNGLSLGFPFSRPFWAPQAHGKGEASGSSRQAGDEKEWRGACTGAVEVGQRVQTSSVAALGNVKPFRTRAGRVQWGVPQCAQEAACGRSSGPAKDSGQPAEPDRTPDAAPPDPSPTEPQEYRVPEKPNEEEKGAPESGEEGLAPDSEVGRKSYRCEQCGKGFSWHSHLVTHRRTHTGEKPYACTDCGKRFGRSSHLIQHQIIHTGEKPYTCPACRKSFSHHSTLIQHQRIHTGEKPYVCDRCAKRFTRRSDLVTHQGTHTGAKPHKCPICAKCFTQSSALVTHQRTHTGVKPYPCPECGKCFSQRSNLIAHNRTHTGEKPYHCLDCGKSFSHSSHLTAHQRTHRGVRPYACPLCGKSFSRRSNLHRHEKIHTTGPKALAMLMLGAAAAGALATPPPAPT

SEQ ID NO: 799880 - protein, 554 aa, Homo sapiens; identical to SEQ ID NO: 799879

SEQ ID NO: 799881 - protein, 554 aa, Homo sapiens; identical to SEQ ID NO: 799879

SEQ ID NO: 799882 - protein, 593 aa, Homo sapiens
MSADGGGIQDTQDKETPPEVPDRGHPHQEMPSKLGEAVPSGDTQESLHIKMEPEEPHSEGASQEDGAQGAWGWAPLSHGSKEKALFLPGGALPSPRIPVLSREGRTRDRQMAAALLTAWSQMPVTFEDVALYLSREEWGRLDHTQQNFYRDVLQKKNGLSLGFPFSRPFWAPQAHGKGEASGSSRQAGDEKEWRGACTGAVEVGQRVQTSSVAALGNVKPFRTRAGRVQWGVPQCAQEAACGRSSGPAKDSGQPAEPDRTPDAAPPDPSPTEPQEYRVPEKPNEEEKGAPESGEEGLAPDSEVGRKSYRCEQCGKGFSWHSHLVTHRRTHTGEKPYACTDCGKRFGRSSHLIQHQIIHTGEKPYTCPACRKSFSHHSTLIQHQRIHTGEKPYVCDRCAKRFTRRSDLVTHQGTHTGAKPHKCPICAKCFTQSSALVTHQPFQPHRAQPHTHRREALPLPRLRQELQPQLAPHRAPAHPPWRAALRLPVVWQELQPALQPAPAREDPHHRAQGPGHADAGGGGGGGSGHTPTRSHLGGQERGSGAPRATGTAPLESRLRGRREGLGKGAGAVRAWGEAWRWGRARARKGRHSAN

SEQ ID NO: 799883 - protein, 517 aa, Homo sapiens
MSADGGGIQDTQDKETPPEVPDRGHPHQEMPSKLGEAVPSGDTQESLHIKMEPEEPHSEGASQEDGAQGAWGWAPLSHGSKEKALFLPGGALPSPRIPVLSREGRTRDRQMAAALLTAWSQMPVTFEDVALYLSREEWGRLDHTQQNFYRDVLQKKNGLSLGAVEVGQRVQTSSVAALGNVKPFRTRAGRVQWGVPQCAQEAACGRSSGPAKDSGQPAEPDRTPDAAPPDPSPTEPQEYRVPEKPNEEEKGAPESGEEGLAPDSEVGRKSYRCEQCGKGFSWHSHLVTHRRTHTGEKPYACTDCGKRFGRSSHLIQHQIIHTGEKPYTCPACRKSFSHHSTLIQHQRIHTGEKPYVCDRCAKRFTRRSDLVTHQGTHTGAKPHKCPICAKCFTQSSALVTHQRTHTGVKPYPCPECGKCFSQRSNLIAHNRTHTGEKPYHCLDCGKSFSHSSHLTAHQRTHRGVRPYACPLCGKSFSRRSNLHRHEKIHTTGPKALAMLMLGAAAAGALATPPPAPT

SEQ ID NO: 799884 - protein, 137 aa, Homo sapiens
PSQLWQPPGRGRTPDPGGLLETALFYPLFPEPHPLLGPISLGEMLSAAGQRQKACDSTASLSGQAFPSAGLSGPLKRTARVRPRAPAGRQEMRRSGEARAQVRDGRAPLSAGVGRRRRPSGCCLWEWGRATRPPPGR

SEQ ID NO: 799885 - protein, 101 aa, Homo sapiens
ALSSLLFQAPGSSVRARETMVSVTMATSEWIQFFKEAGIPPGPAVNYAVMFVDNRIQKSMLLDLNKEIMNELGVTVVGDIIAILKHAKVVHRQQLFKLPLV

SEQ ID NO: 799886 - protein, 385 aa, Homo sapiens
MVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 799887 - protein, 422 aa, Homo sapiens
MVMAALSLVAACWGRAAADESVQLPAAPGSSVRARETMVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 799888 - protein, 355 aa, Homo sapiens
MFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 799889 - protein, 421 aa, Homo sapiens
MATSEWIQFFKEAGIPPGPAVNYAVMFVDNRIQKSMLLDLNKEIMNELGVTVVGDIIAILKHAKVVHRQDMCKAATESVPCSPSPLAGEIRRGTSDGVSLCCPGWSTVALTLAQCNLRLPGSSSSPASASRVAGITAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 799890 - protein, 436 aa, Homo sapiens
RAGGGVSDSWRRREGGRAARVGAGPVGQAPGSSVRARETMVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTRPDCPLRPARPSCTSGLPAAPSSAVASSLLRLLAALYSQAGGTSPDPGLRLRRIRFPALGICL

SEQ ID NO: 799891 - protein, 409 aa, Homo sapiens
RAGGGVSDSWRRREGGRAARVGAGPVGQAPGSSVRARETMVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRTVSRPLLPGWRDLSRPWAAAEAHPFSCPGHLSLKVYGGWWARGTGKGGQCLE

SEQ ID NO: 799892 - protein, 163 aa, Homo sapiens
GRDDSVSWQRRVCRKLVRHERTLYVQEAAKQSGVTCEEAREKQQLQEMEREKSSHIIQVCGLPRRLRDGFSTNVSEANWMRISVPVLERKAVRGENEVQLVPGSQSAGITGVSHRARRIAVFNGKLALLAMRGRKSSGSREQCQGQGDDGLRDYGHFRVDPVL

SEQ ID NO: 799893 - protein, 424 aa, Homo sapiens
RAGGGVSDSWRRREGGRAARVGAGPVGQAPGSSVRARETMVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 799894 - protein, 385 aa, Homo sapiens; identical to SEQ ID NO: 799886

SEQ ID NO: 799895 - protein, 380 aa, Homo sapiens
MATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTSTKSKSSAEVKVTIKRTLVGPRGSSSSEGLGAQMDHAGTVSVFKRLGRRTF

SEQ ID NO: 799896 - protein, 400 aa, Homo sapiens
RAGGGVSDSWRRREGGRAARVGAGPVGQAPGSSVRARETMVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILEQQQAAKGLHRTSVFDRLGAETKADTTTGSKPTGVFSRLGATPETDEDLAWDSDNDSSSSVLQYAGVLKKLGRGPAKASPQPALTVKAKATSSATTAAAPTLRRLALSSRSGLERKPESLSKVSIIKRLGAAALVPEAQDSQVTRPVPRVKTAAVLIYFCDFQIISPTPSG

SEQ ID NO: 799897 - protein, 218 aa, Homo sapiens
MVSVTMATSEWIQFFKEAGIPPGPAVNYAVMFVDNRIQKSMLLDLNKEIMNELGVTVVGDIIAILKHAKVVHRQDMCKAATESVPCSPSPLAGEIRRGTSAASRMITNSLNHDSPPSTPPRRPDTSTSKISVTVSNKMAAKSAKATAALARREEESLAVPAKRRRVTAEMEGKYVINMPKGTTPRTRKILDSSSEGLGAQMDHAGTVSVFKRLGRRTF

SEQ ID NO: 799898 - protein, 112 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRSK

SEQ ID NO: 799899 - protein, 3056 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRSTTPANLDSESEHFFRCCLDKKSQRTMLAVVDYMRRQKRPSSGTIFNDAFWLDLNYLEVAKVAQSCAAHFTALLYAEIYADKKSMDDQEKRSLAFEEGSQSTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVVPLSQRSGVLEWCTGTVPIGEFLVNNEDGAHKRYRPNDFSAFQCQKKMMEVQKKSFEEKYEVFMDVCQNFQPVFRYFCMEKFLDPAIWFEKRLAYTRSVATSSIVGYILGLGDRHVQNILINEQSAELVHIDLGVAFEQGKILPTPETVPFRLTRDIVDGMGITGVEGVFRRCCEKTMEVMRNSQETLLTIVEVLLYDPLFDWTMNPLKALYLQQRPEDETELHPTLNADDQECKRNLSDIDQSFNKVAERVLMRLQEKLKGVEEGTVLSVGGQVNLLIQQAIDPKNLSRLFPGWKAWV

SEQ ID NO: 799900 - protein, 3056 aa, Homo sapiens; identical to SEQ ID NO: 799899

SEQ ID NO: 799901 - protein, 3056 aa, Homo sapiens; identical to SEQ ID NO: 799899

SEQ ID NO: 799902 - protein, 1708 aa, Homo sapiens
MTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRSTTPANLDSESEHFFRCCLDKKSQRTMLAVVDYMRRQKRPSSGTIFNDAFWLDLNYLEVAKVAQSCAAHFTALLYAEIYADKKSMDDQEKRSLAFEEGSQSTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVVPLSQRSGVLEWCTGTVPIGEFLVNNEDGAHKRYRPNDFSAFQCQKKMMEVQKKSFEEKYEVFMDVCQNFQPVFRYFCMEKFLDPAIWFEKRLAYTRSVATSSIVGYILGLGDRHVQNILINEQSAELVHIDLGVAFEQGKILPTPETVPFRLTRDIVDGMGITGVEGVFRRCCEKTMEVMRNSQETLLTIVEVLLYDPLFDWTMNPLKALYLQQRPEDETELHPTLNADDQECKRNLSDIDQSFNKVAERVLMRLQEKLKGVEEGTVLSVGGQVNLLIQQAIDPKNLSRLFPGWKAWV

SEQ ID NO: 799903 - protein, 2903 aa, Homo sapiens
MDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRIHNPCKLGFRPSSGTIFNDAFWLDLNYLEVAKVAQSCAAHFTALLYAEIYADKKSMDDQEKRSLAFEEGSQSTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVVPLSQRSGVLEWCTGTVPIGEFLVNNEDGAHKRYRPNDFSAFQCQKKMMEVQKKSFEEKYEVFMDVCQNFQPVFRYFCMEKFLDPAIWFEKRLAYTRSVATSSIVGYILGLGDRHVQNILINEQSAELVHIDLGVAFEQGKILPTPETVPFRLTRDIVDGMGITGVEGVFRRCCEKTMEVMRNSQETLLTIVEVLLYDPLFDWTMNPLKALYLQQRPEDETELHPTLNADDQECKRNLSDIDQSFNKVAERVLMRLQEKLKGVEEGTVLSVGGQVNLLIQQAIDPKNLSRLFPGWKAWV

SEQ ID NO: 799904 - protein, 1486 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRKLTIFSQ

SEQ ID NO: 799905 - protein, 548 aa, Homo sapiens [sequence omitted]

SEQ ID NO: 799906 - protein, 1486 aa, Homo sapiens; identical to SEQ ID NO: 799904

SEQ ID NO: 799907 - protein, 1906 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRSTTPANLDSDLLQEQFLMMLSGWI

SEQ ID NO: 799908 - protein, 168 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLGMF

SEQ ID NO: 799909 - protein, 168 aa, Homo sapiens; identical to SEQ ID NO: 799908

SEQ ID NO: 799910 - protein, 3056 aa, Homo sapiens; identical to SEQ ID NO: 799899

SEQ ID NO: 799911 - protein, 3056 aa, Homo sapiens; identical to SEQ ID NO: 799899

SEQ ID NO: 799912 - protein, 3056 aa, Homo sapiens; identical to SEQ ID NO: 799899

SEQ ID NO: 799913 - protein, 3056 aa, Homo sapiens; identical to SEQ ID NO: 799899

SEQ ID NO: 799914 - protein, 3027 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRIHNPCKLGFRPSSGTIFNDAFWLDLNYLEVAKVAQSCAAHFTALLYAEIYADKKSMDDQEKRSLAFEEGSQSTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVVPLSQRSGVLEWCTGTVPIGEFLVNNEDGAHKRYRPNDFSAFQCQKKMMEVQKKSFEEKYEVFMDVCQNFQPVFRYFCMEKFLDPAIWFEKRLAYTRSVATSSIVGYILGLGDRHVQNILINEQSAELVHIDLGVAFEQGKILPTPETVPFRLTRDIVDGMGITGVEGVFRRCCEKTMEVMRNSQETLLTIVEVLLYDPLFDWTMNPLKALYLQQRPEDETELHPTLNADDQECKRNLSDIDQSFNKVAERVLMRLQEKLKGVEEGTVLSVGGQVNLLIQQAIDPKNLSRLFPGWKAWV

SEQ ID NO: 799915 - protein, 1641 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQGANFK

SEQ ID NO: 799916 - protein, 3017 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRIHNPCKLGFRPSSGTIFNDAFWLDLNYLEVAKVAQSCAAHFTALLYAEIYADKKSMDDQEKRSLAFEEGSQSTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVVPLSQRSGVLEWCTGTVPIGEFLVNNEDGAHKRYRPNDFSAFQCQKKMMEVQKKSFEEKYEVFMDVCQNFQPVFRYFCMEKFLDPAIWFEKRLAYTRSVATSSIVGYILGLGDRHVQNILINEQSAELVHIDLGVAFEQGKILPTPETVPFRLTRDIVDGMGITGVEGVFRRCCEKTMEVMRNSQETLLTIVEVLLYDPLFDWTMNPLKALYLQQRPEDETELHPTLNADDQECKRNLSDIDQSFNKVAERVLMRLQEKLKGVEEGTVLSVGGQVNLLIQQTPVTLHLA

SEQ ID NO: 799917 - protein, 2747 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRIHNPCKLGFRPSSGTIFNDAFWLDLNYLEVAKVAQSCAAHFTALLYAEIYADKKSMDDQEKRSLAFEEGSQSTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVTICTSVSSPKTYKRCHLVG

SEQ ID NO: 799918 - protein, 2407 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRIHNPCKLGFRPSSGTIFNDAFWLDLNYLEVAKVAQSCAAHFTALLYAEIYADKKSMDDQEKRSLAFEEGSQSTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNR

SEQ ID NO: 799919 - protein, 1350 aa, Homo sapiens
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQVWLQFLCTFHSLNDMRYNL

SEQ ID NO: 799920 - protein, 425 aa, Homo sapiens
MAGRRAQPGSAPPRPAAPHPRPASRAFPQHCRPRDAERPPSPRSPLMPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVRLDLALQGAGDAEAAVVLEAALATLLAVVARLGPDAARGPADPVLLQAQVQEGFGSLRRCYARGAGPHPRQPAFQGLFLLYNLGESGSWRLGSSVGTGAHHDSGGSVEALHEVLQLPAALRACPPLRKALAVDAAFREGNAARLFRLLQTLPYLPSCAVQCHVGHARREALARFARAFSTPKGQTLPLGFMVNLLALDGLREARDLCQAHGLPLDGEERVVFLRGRYVEEGLPPASTCKVLVESKLRGRTLEEVVMAEEEDEGTDRPGSPA

SEQ ID NO: 799921 - protein, 404 aa, Homo sapiens
MAGRRAQPGSAPPRPAAPHPRPASRAFPQHCRPRDAERPPSPRSPLMPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVRLDLALQGAGDAEAAVVLEAALATLLAVVARLGPDAARGPADPVLLQAQVQEGFGSLRRCYARGAGPHPRQPAFQGLFLLYNLGSVEALHEVLQLPAALRACPPLRKALAVDAAFREGNAARLFRLLQTLPYLPSCAVQCHVGHARREALARFARAFSTPKGQTLPLGFMVNLLALDGLREARDLCQAHGLPLDGEERVVFLRGRYVEEGLPPASTCKVLVESKLRGRTLEEVVMAEEEDEGTDRPGSPA

SEQ ID NO: 799922 - protein, 358 aa, Homo sapiens
MPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVRLDLALQGAGDAEAAVVLEAALATLLAVVARLGPDAARGPADPVLLQAQVQEGFGSLRRCYARGAGPHPRQPAFQGLFLLYNLGSVEALHEVLQLPAALRACPPLRKALAVDAAFREGNAARLFRLLQTLPYLPSCAVQCHVGHARREALARFARAFSTPKGQTLPLGFMVNLLALDGLREARDLCQAHGLPLDGEERVVFLRGRYVEEGLPPASTCKVLVESKLRGRTLEEVVMAEEEDEGTDRPGSPA

SEQ ID NO: 799923 - protein, 206 aa, Homo sapiens
MAGRRAQPGSAPPRPAAPHPRPASRAFPQHCRPRDAERPPSPRSPLMPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVRLDLALQGAGPANPPSRASFCSITWARWKPCMRFYSCLLPCAPARPSARPWR

SEQ ID NO: 799924 - protein, 385 aa, Homo sapiens
MAGRRAQPGSAPPRPAAPHPRPASRAFPQHCRPRDAERPPSPRSPLMPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVRLDLALQGAGDAEAAVVLEAALATLLAVVARLGPDAARGPADPVLLQAQVQEGFGSLRRCYARGAGPHPRQPAFQGLFLLYNLGSVEALHEVLQLPAALRAARLFRLLQTLPYLPSCAVQCHVGHARREALARFARAFSTPKGQTLPLGFMVNLLALDGLREARDLCQAHGLPLDGEERVVFLRGRYVEEGLPPASTCKVLVESKLRGRTLEEVVMAEEEDEGTDRPGSPA

SEQ ID NO: 799925 - protein, 184 aa, Homo sapiens
MPSEWFIFVHTVPLKKAGSVEALHEVLQLPAALRACPPLRKALAVDAAFREGNAARLFRLLQTLPYLPSCAVQCHVGHARREALARFARAFSTPKGQTLPLGFMVNLLALDGLREARDLCQAHGLPLDGEERVVFLRGRYVEEGLPPASTCKVLVESKLRGRTLEEVVMAEEEDEGTDRPGSPA

SEQ ID NO: 799926 - protein, 269 aa, Homo sapiens
MAGRRAQPGSAPPRPAAPHPRPASRAFPQHCRPRDAERPPSPRSPLMPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVRLDLALQGAGDAEAAVVLEAALATLLAVVARLGPDAARGPADPVLLQAQVQEGFGSLRRCYARGAGPHPRQPAFQGLFLLYNLEMGSRMLPLEFLGSSDPPAPPSQVAGCGHHAQ

SEQ ID NO: 799927 - protein, 428 aa, Homo sapiens
TKRLVAAGTTPVYHGSGPGYTLKTLRGAREAELGARWGPLAALERAEPQRRSWTTTQCISGGQLDWTGPLMPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVRLDLALQGAGDAEAAVVLEAALATLLAVVARLGPDAARGPADPVLLQAQVQEGFGSLRRCYARGAGPHPRQPAFQGLFLLYNLGSVEALHEVLQLPAALRACPPLRKALAVDAAFREGNAARLFRLLQTLPYLPSCAVQCHVGHARREALARFARAFSTPKGQTLPLGFMVNLLALDGLREARDLCQAHGLPLDGEERVVFLRGRYVEEGLPPASTCKVLVESKLRGRTLEEVVMAEEEDEGTDRPGSPA

SEQ ID NO: 799928 - protein, 339 aa, Homo sapiens
MPGCELPVGTCPDMCPAAERAQREREHRLHRLEVVPGCRQDPPRADPQRAVKEYSRPAAGKPRPPPSQLRPPSVLLATVRYLAGEVAESADIARAEVASFVADRLRAVRLDLALQGAGDAEAAVVLEAALATLLAVVARLGPDAARGPADPVLLQAQVQEGFGSLRRCYARGAGPHPRQPAFQGLFLLYNLGSVEALHEVLQLPAALRAARLFRLLQTLPYLPSCAVQCHVGHARREALARFARAFSTPKGQTLPLGFMVNLLALDGLREARDLCQAHGLPLDGEERVVFLRGRYVEEGLPPASTCKVLVESKLRGRTLEEVVMAEEEDEGTDRPGSPA

SEQ ID NO: 799929 - protein, 707 aa, Homo sapiens
DESYSEEEEEMPDSDENGSYSTSSDPSDDSKAVAIIKSVGELSVPEKYKSIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGFAWATDLSTDLESQLSVSCKCYEAANEILQFSDLKSQNPEHYVQVLKRMGNIRNEIGVFYMNQAAALQSERLVSKSVSAAEQQLWKKSFSCFEKGIHNFESIEDATNAALLLCNTGRLMRICAQAHCGAGDELKREFSPEEGLYYNKAIDYYLKALRSLGTRDIHPAVWDSVNWELSTTYFTMATLQQDYAPLSRKAQEQIEKEVSEAMMKSLKYCDVDSVSARQPLCQYRAATIHHRLASMYHSCLRNQVGDEHLRKQHRVLADLHYSKAAKLFQLLKDAPCELLRVQLERVAFAEFQMTSQNSNVGKLKTLSGALDIMVRTEHAFQLIQKELIEEFGQPKSGDAAAAADASPSLNREEVMKLLSIFESRLSFLLLQSIKLLSSTKKKTSNNIEDDTILKTNKHIYSQLLRATANKTATLLERINVIVHLLGQLAAGSAASSNAVQ

SEQ ID NO: 799930 - protein, 148 aa, Homo sapiens
MTSQNSNVGKLKTLSGALDIMVRTEHAFQLIQKELIEEFGQPKSGDAAAAADASPSLNREEVMKLLSIFESRLSFLLLQSIKLLSSTKKKTSNNIEDDTILKTNKHIYSQLLRATANKTATLLERINVIVHLLGQLAAGSAASSNAVQ

SEQ ID NO: 799931 - protein, 707 aa, Homo sapiens; identical to SEQ ID NO: 799929

SEQ ID NO: 799932 - protein, 477 aa, Homo sapiens
DESYSEEEEEMPDSDENGSYSTSSDPSDDSKAVAIIKSVGELSVPEKYKSIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGFAWATDLSTDLESQLSVSCKCYEAANEILQFSDLKSQNPEHYVQVLKRMGNIRNEIGVFYMNQAAALQSERLVSKSVSAAEQQLWKKSFSCFEKGIHNFESIEDATNAALLLCNTGRLMRICAQAHCGAGDELKREFSPEEGLYYNKKEKKKQRKQVHHHAQPESESSSTDWLLVALRWEHRVVFSLLGITFFIEIFSLTYFFHFLIILSLYKLSQN

SEQ ID NO: 799933 - protein, 366 aa, Homo sapiens
DESYSEEEEEMPDSDENGSYSTSSDPSDDSKAVAIIKSVGELSVPEKYKSIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGVPQAWTTWFTVGLCSLAHAYLSIQKRGRNIRVLIFALYLFIYFLRRSFALVAQAGVQWCNLGSLKPPPPGFKQFSCLSLPSSWNYRHAPPCPASPPWPPKVLGLQV

SEQ ID NO: 799934 - protein, 585 aa, Homo sapiens
MALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGFAWATDLSTDLESQLSVSCKCYEAANEILQFSDLKSQNPEHYVQVLKRMGNIRNEIGVFYMNQAAALQSERLVSKSVSAAEQQLWKKSFSCFEKGIHNFESIEDATNAALLLCNTGRLMRICAQAHCGAGDELKREFSPEEGLYYNKAIDYYLKALRSLGTRDIHPAVWDSVNWELSTTYFTMATLQQDYAPLSRKAQEQIEKEVSEAMMKSLKYCDVDSVSARQPLCQYRAATIHHRLASMYHSCLRNQVGDEHLRKQHRVLADLHYSKAAKLFQLLKDAPCELLRVQLERVAFAEFQMTSQNSNVGKLKTLSGALDIMVRTEHAFQLIQKELIEEFGQPKSGDAAAAADASPSLNREEVMKLLSIFESRLSFLLLQSIKLLSSTKKKTSNNIEDDTILKTNKHIYSQLLRATANKTATLLERINVIVHLLGQLAAGSAASSNAVQ

SEQ ID NO: 799935 - protein, 564 aa, Homo sapiens
DESYSEEEEEMPDSDENGSYSTSSDPSDDSKAVAIIKSVGELSVPEKYKSIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGFAWATDLSTDLESQLSVSCKCYEAANEILQFSDLKSQNPEHYVQVLKRMGNIRNEIGVFYMNQAAALQSERLVSKSVSAAEQQLWKKSFSCFEKGIHNFESIEDATNAALLLCNTGRLMRICAQAHCGAGDELKREFSPEEGLYYNKAIDYYLKALRSLGTRDIHPAVWDSVNWELSTTYFTMATLQQDYAPLSRKAQEQIEKEVSEAMMKSLKYCDVDSVSARQPLCQYRAATIHHRLASMYHSCLRNQVGDEHLRKQHRVLADLHYSKAAKLFQLLKDAPCELLRVQLERVAFAEFQMTSKS

SEQ ID NO: 799936 - protein, 164 aa, Homo sapiens
MALVLEPDADDPRAQAGHLHQLLLHESVGPRVGGVAGPQSVQLLLVQHSPHAGRLLRLLVHVRAQRGLPARPSVCQDRSQDPRNERSPPEEVGVSEEEERGLPRTLERERDRRGPRARRCPGTGWEVRICRGPTRALPLLQSPFGQGQATCVEDSSTVMDGPPG

SEQ ID NO: 799937 - protein, 142 aa, Homo sapiens
FRSCSMATWRTWSCEAKESFSCTWLSQHQLLRLISKRELLCNFRIGADIFTCAHTVCFHSLIILFSLLKERLIRINMLVCLTWMVEEQRAVLESLFHYQLTSAWFFWVRTSNKTVLCVSFFFLAPPISLINTNPIKISQNYI

SEQ ID NO: 799938 - protein, 420 aa, Homo sapiens
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFNQLPAVLGAQGFGAGRHCWEVETADAASCRDSSGEDADDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 799939 - protein, 230 aa, Homo sapiens
MRKTWRRFEVPTSKSSNSEDDLPEDYPVVKKMLHRLTADLTLDPGTAHRRLLISADRRSVQLAPPGTPAPPDGPKRFNQLPAVLGAQGFGAGRHCWEVETADAASCRDSSGEDADDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 799940 - protein, 203 aa, Homo sapiens
MGPLPASPSPADLTLDPGTAHRRLLISADRRSVQLAPPGTPAPPDGPKRFNQLPAVLGAQGFGAGRHCWEVETADAASCRDSSGEDADDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 799941 - protein, 354 aa, Homo sapiens
MWWRDLTRLRLWLKREAIPGEGRKAAKVNAGVGEKGIYTASSRGGPPSARSKAVTVVAEGAASRSWLSMDAPELGPGLVERLEQLATCPLCGGSFEDPVLLACEHSFCRACLARRWGTPPATGTEASPTACPCCGLPCPRRSLRSNVRLAVEVRISRELREKLAEPGARAGRRRGGRIPTMGCLDLPGEDMRKTWRRFEVPTSKSSNSEDDLPEDYPVVKKMLHRLTADLTLDPGTAHRRLLISADRRSVQLAPPGTPAPPDGPKRFNQLPAVLGAQGFGAGRHCWEVETADAASCRDSSGEDADDEESHYAVGAAGESVQRKGCAPGPLGERIFPLFCTCDPRAPLRIVPAES

SEQ ID NO: 799942 - protein, 199 aa, Homo sapiens
MLHRLTADLTLDPGTAHRRLLISADRRSVQLAPPGTPAPPDGPKRFNQLPAVLGAQGFGAGRHCWEVETADAASCRDSSGEDADDEESHYAVGAAGESVQRKGCVRLCPAGAVWAVEGRGGRLWALTAPEPTLLGGVEPPPRRIRVDLDWERGRVAFYDGRSLDLLYAFQAPGPLGERIFPLFCTCDPRAPLRIVPAES

SEQ ID NO: 799943 - protein, 342 aa, Homo sapiens
DFRQLDLEKQGVSGMATKRLARQLGLIRRKSIAPANGNLGRSKSKQLFDYLIVIDFESTCWNDGKHHHSQEIIEFPAVLLNTSTGQIDSEFQAYVQPQEHPILSEFCMELTGIKQAQVDEGVPLKICLSQFCKWIHKIQQQKNIIFATGISEPSASEVKLCAFVTWSDWDLGVCLEYECKRKQLLKPVFLNSWIDLRATYKLFYRRKPKGLSGALQEVGIEFSGREHSGLDDSRNTALLAWKMIRDGCVMKITRSLNKGPFLLPSWTWNSDLASGDQHAFLQQEFGCGTYRTLLQKPNMSKQEKGNILWLTMVWLSLACLQRKNYNDCMLNTASQTVTTEKF

SEQ ID NO: 799944 - protein, 218 aa, Homo sapiens
MELTGIKQAQVDEGVPLKICLSQFCKWIHKIQQQKNIIFATGISEPSASEVKLCAFVTWSDWDLGVCLEYECKRKQLLKPVFLNSWIDLRATYKLFYRRKPKGLSGALQEVGIEFSGREHSGLDDSRNTALLAWKMIRDGCVMKITRSLNKGPFLLPSWTWNSDLASGDQHAFLQQEFGYFFNFLSFGLLFRTTNLSRKGQVPILAVEPTEPYFRSPI

SEQ ID NO: 799945 - protein, 308 aa, Homo sapiens
DFRQLDLEKQGVSGMATKRLARQLGLIRRKSIAPANGNLGRSKSKQLFDYLIVIDFESTCWNDGKHHHSQEIIEFPAVLLNTSTGQIDSEFQAYVQPQEHPILSEFCMELTGIKQAQVDEGVPLKICLSQFCKWIHKIQQQKNIIFATGISEPSASEVKLCAFVTWSDWDLGVCLEYECKRKQLLKPVFLNSWIDLRATYKLFYRRKPKGLSGALQEVGIEFSGREHSGLDDSRNTALLAWKMIRDGCVMKITRSLNKVPTKKNFSILARNLNTIQVEEMSACNISIQGPSIYNKEPKNIINPHEKVQ

SEQ ID NO: 799946 - protein, 91 aa, Homo sapiens
RLPAAGLGKARSVGNGDQAARAVLEGVPGRGRVAPGPALALAAEQGTAGGICGEGLYSPQPRRLRPALSGTVGKAPPWTSVFSLGPPSTRG

SEQ ID NO: 799947 - protein, 325 aa, Homo sapiens
DFRQLDLEKQGVSGMATKRLARQLGLIRRKSIAPANGNLGRSKSKQLFDYLIVIDFESTCWNDGKHHHSQEIIEFPAVLLNTSTGQIDSEFQAYVQPQEHPILSEFCMELTGIKQAQVDEGVPLKICLSQFCKWIHKIQQQKNIIFATGISEPSASEVKLCAFVTWSDWDLGVCLEYECKRKQLLKPVFLNSWIDLRATYKLFYRRKPKGLSGALQEVGIEFSGREHSGLDDSRNTALLAWKMIRDGCVMKITRSLNKGPFLLPSWTWNSDLASGDQHAFLQQEFGYFFNFLSFGLLFRTTNLSRKGQVPILAVEPTEPYFRSPI

SEQ ID NO: 799948 - protein, 402 aa, Homo sapiens
RLPAAGLGKARSVGNGDQAARAKGYTRQQFCQESTLNKGDRVIYNVARPPYCCVRFPLAGTGPHILYLSRLTSNIELFKRGKGRGEQRKKEVTCGMLRKQLGLIRRKSIAPANGNLGRSKSKQLFDYLIVIDFESTCWNDGKHHHSQEIIEFPAVLLNTSTGQIDSEFQAYVQPQEHPILSEFCMELTGIKQAQVDEGVPLKICLSQFCKWIHKIQQQKNIIFATGISEPSASEVKLCAFVTWSDWDLGVCLEYECKRKQLLKPVFLNSWIDLRATYKLFYRRKPKGLSGALQEVGIEFSGREHSGLDDSRNTALLAWKMIRDGCVMKITRSLNKGPFLLPSWTWNSDLASGDQHAFLQQEFGYFFNFLSFGLLFRTTNLSRKGQVPILAVEPTEPYFRSPI

SEQ ID NO: 799949 - protein, 290 aa, Homo sapiens
DFRQLDLEKQGVSGMATKRLARQLGLIRRKSIAPANGNLGRSKSKQLFDYLIVIDFESTCWNDGKHHHSQEIIEFPAVLLNTSTGQIDSEFQAYVQPQEHPILSEFCMELTGIKQAQVDEGVPLKICLSQFCKWIHKIQQQKNIIFATGISEPSASEVKLCAFVTWSDWDLGVCLEYECKRKQLLKPVFLNSWIDLRATYKLFYRRKPKGLSGALQEVGIEFSGREHSGLDDSRNTALLAWKMIRDGCVMARNLNTIQVEEMSACNISIQGPSIYNKEPKNIINPHEKVQ

SEQ ID NO: 799950 - protein, 594 aa, Homo sapiens
SGAPAALVPAAAGDHSPPLRRLHPRPPPGRASGAPAPSPWTRRPRCAGRRRGRKMAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLDLDIPMSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREKMEKRTAHEKEKYQPSYDTTILTEMRLEPIIEDAVEHEQKKSSKRTLPADYGDSLAKRGSCSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRSVRPRLTIYVCREQPSSTVLQGQQQAASSASENGSGAPYVYHAIYLEEMIASEVARKLALVFNIPLHQINQVYRQGPTGIHILVSDQMVQNFQDESCFLFSTVKAESSDGIHIILK

SEQ ID NO: 799951 - protein, 388 aa, Homo sapiens
MSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREKMEKRTAHEKEKYQPSYDTTILTEMRLEPIIEDAVEHEQKKSSKRTLPADYGDSLAKRGSCSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRSVRPRLTIYVCREQPSSTVLQGQQQAASSASENGSGAPYVYHAIYLEEMIASEVARKLALVFNIPLHQINQVYRQGPTGIHILVSDQMVQNFQDESCFLFSTVKAESSDGIHIILK

SEQ ID NO: 799952 - protein, 468 aa, Homo sapiens
SGAPAALVPAAAGDHSPPLRRLHPRPPPGRASGAPAPSPWTRRPRCAGRRRGRKMAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLDLDIPMSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREKMEKRTAHEKEKYQPSYDTTILTECSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRAGPDMMQALMRAEVDCKTGRNAHGQY

SEQ ID NO: 799953 - protein, 594 aa, Homo sapiens; identical to SEQ ID NO: 799950

SEQ ID NO: 799954 - protein, 572 aa, Homo sapiens
SGAPAALVPAAAGDHSPPLRRLHPRPPPGRASGAPAPSPWTRRPRCAGRRRGRKMAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLDLDIPMSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREKMEKRTAHEKEKYQPSYDTTILTEMRLEPIIEDAVEHEQKKSSKRTLPADYGDSLAKRGSCSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRSVRPRLTIYVCREQPSSTVLQGQQQAASSASENGSGAPYVYHAIYLEEMIASEVARQGPTGIHILVSDQMVQNFQDESCFLFSTVKGTLHVCVS

SEQ ID NO: 799955 - protein, 468 aa, Homo sapiens; identical to SEQ ID NO: 799952

SEQ ID NO: 799956 - protein, 558 aa, Homo sapiens
SGAPAALVPAAAGDHSPPLRRLHPRPPPGRASGAPAPSPWTRRPRCAGRRRGRKMAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLDLDIPMSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREKMEKRTAHEKEKYQPSYDTTILTECSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRSVRPRLTIYVCREQPSSTVLQGQQQAASSASENGSGAPYVYHAIYLEEMIASEVARKLALVFNIPLHQINQVYRQGPTGIHILVSDQMVQNFQDESCFLFSTVKAESSDGIHIILK

SEQ ID NO: 799957 - protein, 576 aa, Homo sapiens
SGAPAALVPAAAGDHSPPLRRLHPRPPPGRASGAPAPSPWTRRPRCAGRRRGRKMAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLDLDIPMSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREKMEKRTAHEKEKYQPSYDTTILTEMRLEPIIEDAVEHEQKKSSKRTLPADYGDSLAKRGSCSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRSVRPRLTIYVCREQPSSTVLQGQQQAASSASENGSGAPYVYHAIYLEEMIASEVARQGPTGIHILVSDQMVQNFQDESCFLFSTVKAESSDGIHIILK

SEQ ID NO: 799958 - protein, 594 aa, Homo sapiens; identical to SEQ ID NO: 799950

SEQ ID NO: 799959 - protein, 594 aa, Homo sapiens; identical to SEQ ID NO: 799950

SEQ ID NO: 799960 - protein, 343 aa, Homo sapiens
SGAPAALVPAAAGDHSPPLRRLHPRPPPGRASGAPAPSPWTRRPRCAGRRRGRKMAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSGMSGPRCCWALSVEGHSIGKTCPLWICLFSESIIRVVFHDRRLQYTEHQQLEGWKWNRPGDRLLDLDIPMSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREQWYDHGSL

SEQ ID NO: 799961 - protein, 71 aa, Homo sapiens [sequence omitted]

SEQ ID NO: 799962 - protein, 104 aa, Homo sapiens
GDGGHHPLNPRVPVPHLARTAPPLHPREYCKQRWQVQACTGRGLQETDPWPLIWCSGSQAQSQAWALHPHPLRGARTERSPQVTQVYLSVLMLLINTYPRLGNL

SEQ ID NO: 799963 - protein, 537 aa, Homo sapiens
PTSSGRALALSPPQSATGPGVPMCQVGEDYGEPAPEEPPPAPRPSREQKCVKCKEAQPVVVIRAGDAFCRDCFKAFYVHKFRAMLGKNRLIFPGEKVLLAWSGGPSSSSMVWQVLEGLSQDSAKRLRFVAGVIFVDEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSRMQSPIPLTETRTPPGPCCSPGVGWAQRCGQGACRREDPQACIEEQLCYSCRVNMKDLPSLDPLPPYILAEAQLRTQRAWGLQEIRDCLIEDSDDEAGQS

SEQ ID NO: 799964 - protein, 537 aa, Homo sapiens; identical to SEQ ID NO: 799963

SEQ ID NO: 799965 - protein, 518 aa, Homo sapiens
PTSSGRALALSPPQSATGPGVPMCQVGEDYGEPAPEEPPPAPRPSREQKCVKCKEAQPVVVIRAGDAFCRDCFKAFYVHKFRAMLGKNRLIFPGEKVLLAWSGGPSSSSMVWQVLEGLSQDSAKRLRFVAGVIFVDEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKTQFPSTVSTVYRTSEKLVKGPRDGPAAGDSGPRCLLCMCALDVDAADSATAFGAQTSSRLSRMQSPIPLTETRTPPGPCCSPGVGWAQRCGQGACRREDPQACIEEQLCYSCRVNMKDLPSLDPLPPYILAEAQLRTQRAWGLQEIRDCLIEDSDDEAGQS

SEQ ID NO: 799966 - protein, 562 aa, Homo sapiens
PTSSGRALALSPPQSATGPGVPMCQVGEDYGEPAPEEPPPAPRPSREQKCVKCKEAQPVVVIRAGDAFCRDCFKAFYVHKFRAMLGKNRLIFPGEKVLLAWSGGPSSSSMVWQVLEGLSQDSAKRLRFVAGVIFVDEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSRMQSPIPLTETRTPPGPCCSPGVGWAQRCGQGACRREDPQACIEEQLCYSCRVNMKDLPSLDPLPPYILAEAQLRTQRYWGPHCRGAWVRGLGAGAHCSFLSRAWGLQEIRDCLIEDSDDEAGQS

SEQ ID NO: 799967 - protein, 503 aa, Homo sapiens
IRLGTRLGGAGVPMCQVGEDYGEPAPEEPPPAPRPRDCFKAFYVHKFRAMLGKNRLIFPGEKVLLAWSGGPSSSSMVWQVLEGLSQDSAKRLRFVAGVIFVDEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSRMQSPIPLTETRTPPGPCCSPGVGWAQRCGQGACRREDPQACIEEQLCYSCRVNMKDLPSLDPLPPYILAEAQLRTQRAWGLQEIRDCLIEDSDDEAGQS

SEQ ID NO: 799968 - protein, 528 aa, Homo sapiens
IRLGTRLGGAGVPMCQVGEDYGEPAPEEPPPAPRPSREQKCVKCKEAQPVVVIRAGDAFCRDCFKAFYVHKFRAMLGKNRLIFPGEKVLLAWSGGPSSSSMVWQVLEGLSQDSAKRLRFVAGVIFVDEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSRMQSPIPLTETRTPPGPCCSPGVGWAQRCGQGACRREDPQACIEEQLCYSCRVNMKDLPSLDPLPPYILAEAQLRTQRAWGLQEIRDCLIEDSDDEAGQS

SEQ ID NO: 799969 - protein, 473 aa, Homo sapiens
PTSSGRALALSPPQSATGPGVPMCQVGEDYGEPAPEEPPPAPRPSREQKCVKCKEAQPVVVIRAGDAFCRDCFKAFYVHKFRAMLGKNRLIFPGEKVLLAWSGGPSSSSMVWQVLEGLSQDSAKRLRFVAGVIFVDEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSRMQSPIPLTETRTPPGPCCSPGVGWAQRCGQGACRR

SEQ ID NO: 799970 - protein, 516 aa, Homo sapiens
MIETGVNRDEGERRLRSRPGAAASREQKCVKCKEAQPVVVIRAGDAFCRDCFKAFYVHKFRAMLGKNRLIFPGEKVLLAWSGGPSSSSMVWQVLEGLSQDSAKRLRFVAGVIFVDEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSRMQSPIPLTETRTPPGPCCSPGVGWAQRCGQGACRREDPQACIEEQLCYSCRVNMKDLPSLDPLPPYILAEAQLRTQRAWGLQEIRDCLIEDSDDEAGQS

SEQ ID NO: 799971 - protein, 603 aa, Homo sapiens
IRLGTRLGGAGVPMCQVGEDYGEPAPEEPPPAPRPSREQKCVKCKEAQPVVVIRAGDAFCRDCFKAFYVHKFRAMLGKNRLIFPGEKVLLAWSGGPSSSSMVWQVLEGLSQDSAKRLRFVAGVIFVDERTPGVLTVALRSAAREKPLPTRHTWRNHHSSAMEAPTCGDEASNGKPRWQMALTACPDMDPLMSPDSFCLLVITEGAACGQSLEERSKTLAEVKPILQATGFPWHVVALEEVFSLPPSVLWCSAQELVGSEGAYKAAVDSFLQQQHVLGAGGGPGPTQGEEQPPQPPLDPQNLARPPAPAQTEALSQLFCSVRTLTAKEELLQTLRTHLILHMARAHGYSKVMTGDSCTRLAIKLMTNLALGRGAFLAWDTGFSDERHGDVVVVRPMRDHTLKEVAFYNRLFSVPSVFTPAVDTKAPEKASIHRLMEAFILRLQTQFPSTVSTVYRTSEKLVKGPRDGPAAGDSGPRCLLCMCALDVDAADSATAFGAQTSSRLSRMQSPIPLTETRTPPGPCCSPGVGWAQRCGQGACRREDPQACIEEQLCYSCRVNMKDLPSLDPLPPYILAEAQLRTQRAWGLQEIRDCLIEDSDDEAGQS

SEQ ID NO: 799972 - protein, 118 aa, Homo sapiens
MVARVWSLMRFLIKGSVAGGAVYLVYDQELLGPSDKSQAALQKAGEVVPPAMYQFSQYVCQQTGLQIPQLPAPPKIYFPIRDSWNAGIMTVMSALSVAPSKAREYSKEGWEYVKARTK

SEQ ID NO: 799973 - protein, 118 aa, Homo sapiens; identical to SEQ ID NO: 799972

SEQ ID NO: 799974 - protein, 115 aa, Homo sapiens
MVARVWSLMRFLIKGSVAGGAVYLVYDQELLGPSDKSQAALQKAGEVVPPAMYQFSQYVCQQTGLQIPQLPAPPKIYFPIRDSWNAGWYGGALVVPATWEAEARESLEPRRRRLQ

SEQ ID NO: 799975 - protein, 884 aa, Homo sapiens
NSAPSSPRRPSSLKRLFRATRPSGTEARAGRHVRFAASGNDASCVSRQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799976 - protein, 884 aa, Homo sapiens; identical to SEQ ID NO: 799975

SEQ ID NO: 799977 - protein, 884 aa, Homo sapiens; identical to SEQ ID NO: 799975

SEQ ID NO: 799978 - protein, 861 aa, Homo sapiens
NSAPSSPRRPSSLKRLFRATRPSGTEARAGRHVRFAASGNDASCVSRQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799979 - protein, 573 aa, Homo sapiens
MEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799980 - protein, 884 aa, Homo sapiens; identical to SEQ ID NO: 799975

SEQ ID NO: 799981 - protein, 884 aa, Homo sapiens; identical to SEQ ID NO: 799975

SEQ ID NO: 799982 - protein, 884 aa, Homo sapiens; identical to SEQ ID NO: 799975

SEQ ID NO: 799983 - protein, 910 aa, Homo sapiens
NSAPSSPRRPSSLKRLFRATRPSGTEARAGRHVRFAASGNDASCVSRQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVGGLSGAWACWGGSAASPPAPCRRPQVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799984 - protein, 573 aa, Homo sapiens; identical to SEQ ID NO: 799979

SEQ ID NO: 799985 - protein, 603 aa, Homo sapiens
ARYEAGVKSAEAGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799986 - protein, 618 aa, Homo sapiens
ERITIGRVPGFTFVTEGLASCSESKWAGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799987 - protein, 593 aa, Homo sapiens
MRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799988 - protein, 984 aa, Homo sapiens
NSAPSSPRRPSSLKRLFRATRPSGTEARAGRHVRFAASGNDASCVSRQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVRAERPGDPLTRQCRVQDEAEAFRVLGSPSQLRGHRRDAGPDGTDGSLPTHSHAQQAARPRQGVGAALTRGLPSPDPGVSPLGGLARGTARGTTCCLLPQVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799989 - protein, 1010 aa, Homo sapiens
NSAPSSPRRPSSLKRLFRATRPSGTEARAGRHVRFAASGNDASCVSRQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVRAERPGDPLTRQCRVQDEAEAFRVLGSPSQLRGHRRDAGPDGTDGSLPTHSHAQQAARPRQGVGAALTRGLPSPDPGVSPLGGLARGTARGTTCCLLPQVDKIGRGYQGDPSSALLELLDPEQNANFLDHYLDVPVDLSKVGGLSGAWACWGGSAASPPAPCRRPQVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799990 - protein, 645 aa, Homo sapiens
MEERKHSLFFSPEIAYPKDKALRGKETGFGFSFDSLGPVSLGLVSPPGTALLHLPGRPWPGPVGGGEGVDGAGGWGSQGHAPTQPTTLLEHCWAPATLPHTWQALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799991 - protein, 580 aa, Homo sapiens
MAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799992 - protein, 447 aa, Homo sapiens
TRGSPTTSTLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799993 - protein, 906 aa, Homo sapiens
NSAPSSPRRPSSLKRLFRATRPSGTEARAGRHVRFAASGNDASCVSRQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVRAERPGDPLTRQCRVQDEAEAFRVLGSPSQLRGHRRDAGPDGTDGSLPTHSHAQQAARPRQGVGAALTRGLPSPDPGVSPLGGLARGTARGTTCCLLPQVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 799994 - protein, 535 aa, Homo sapiens
NSAPSSPRRPSSLKRLFRATRPSGTEARAGRHVRFAASGNDASCVSRQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLTARQA

SEQ ID NO: 799995 - protein, 134 aa, Homo sapiens
MQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 799996 - protein, 140 aa, Homo sapiens
MRSECVLGAASDSGQEAPRDTWFLQGWKASRRFLIKGSVAGGAVYLVYDQELLGPSDKSQAALQKAGEVVPPAMYQFSQYVCQQTGLQIPQLPAPPKIYFPIRDSWNAGIMTVMSALSVAPSKAREYSKEGWEYVKARTK

SEQ ID NO: 799997 - protein, 140 aa, Homo sapiens
SPARARVDLSGSDLFSGHLQASARHLTPLSPHGARAGPNYISQEAPRPGANSAVLTTFPRQPCGGPGLKASISQRPSAARPQPFSGVSEPQDTTTPRGPCVGQERLHLPEASAAPRQEAAGEPSVLARGSERPWWPGCGR

SEQ ID NO: 799998 - protein, 102 aa, Homo sapiens
MVARVWSLMRFLIKGSVAGGAVYLVYDQELLGPSDKSQAALQKAGEVVPPAMYQFSQYVCQQTGLQIPQVLRAGNEARVWRVVSSGRSLQPCTMLSSILMLT

SEQ ID NO: 799999 - protein, 37 aa, Homo sapiens
MQAGQRVVDNPIYLSDMGAALTGAESHELQDVLEETN

SEQ ID NO: 800000 - protein, 832 aa, Homo sapiens
MAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 800001 - protein, 118 aa, Homo sapiens; identical to SEQ ID NO: 799972

SEQ ID NO: 800002 - protein, 113 aa, Homo sapiens
EGRKERRERVEEEDETECKKRIREREGIRRGEERMIREEESRRERGKRNVEGRTTGRLAVVREKARGRDESVATACLMTTRAMVKRLTLRQRGCASAPFLDKFEGPFVLGDLQ

SEQ ID NO: 800003 - protein, 884 aa, Homo sapiens; identical to SEQ ID NO: 799975

SEQ ID NO: 800004 - protein, 884 aa, Homo sapiens; identical to SEQ ID NO: 799975

SEQ ID NO: 800005 - protein, 710 aa, Homo sapiens
MYEAGVNLAEAVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 800006 - protein, 543 aa, Homo sapiens
ARSRLGLNRPRRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKGERPHSLHLRQSLPHAARPRQ

SEQ ID NO: 800007 - protein, 900 aa, Homo sapiens
NSAPSSPRRPSSLKRLFRATRPSGTEARAGRHVRFAASGNDASCVSRQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGERGGGRRPQSHSHFYPRTSRSHLVHLCSGPQVALNGLWRGVVCWEPRGSGLREGKAVTHGGGSTPWALWIWVPL

SEQ ID NO: 800008 - protein, 785 aa, Homo sapiens
NSAPSSPRRPSSLKRLFRATRPSGTEARAGRHVRFAASGNDASCVSRQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEMAGLWIWAASGLAALI

SEQ ID NO: 800009 - protein, 444 aa, Homo sapiens
NSAPSSPRRPSSLKRLFRATRPSGTEARAGRHVRFAASGNDASCVSRQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLKDLSWRRRLTEQVKAGRGGGKHSTPVCGPPLSG

SEQ ID NO: 800010 - protein, 342 aa, Homo sapiens
NSAPSSPRRPSSLKRLFRATRPSGTEARAGRHVRFAASGNDASCVSRQYGRAMAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVK

SEQ ID NO: 800011 - protein, 111 aa, Homo sapiens
MRSECVLGAASDSGQEAPRDTWFLQGWKASRRFLIKGSVAGGAVYLVYDQELLGPSDKSQAALQKAGEVVPPAMYQFSQYVCQQTGLQIPQLPAPPKIYFPIRDSWNAGGI

SEQ ID NO: 800012 - protein, 171 aa, Homo sapiens
MAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEEVSGPRMVFIRPGPLRSAERQMPLAPGA

SEQ ID NO: 800013 - protein, 244 aa, Homo sapiens
PPAHVTVFGPARTMAGMVDFQDEEQVKSFLENMEVECNYHCYHEKDPDGCYRLVDYLEGIRKNFDEAAKVLKFNCEENQHSDSCYKLGAYYVTGKGGLTQDLKAAARCFLMACEKPGKKSIAACHNVGLLAHDGQVNEDGQPDLGKARDYYTRACDGGYTSSCFNLSAMFLQGAPGFPKDMDLACKYSMKACDLGHIWACANASRMYKLGDGVDKDEAKAEVLKNRAQQLHKEQQKGVQPLTFG

SEQ ID NO: 800014 - protein, 244 aa, Homo sapiens; identical to SEQ ID NO: 800013

SEQ ID NO: 800015 - protein, 244 aa, Homo sapiens; identical to SEQ ID NO: 800013

SEQ ID NO: 800016 - protein, 244 aa, Homo sapiens; identical to SEQ ID NO: 800013

SEQ ID NO: 800017 - protein, 102 aa, Homo sapiens
DRPCRGSSWEEGEHLGASAEPLAILQRDEDGPNIDNMTMEAERPDPELFDPSSCPGEWLSEPDCTLESVRGPRAQGLPPRRSHQHGPPRGATSFLQHVTGHH

SEQ ID NO: 800018 - protein, 449 aa, Homo sapiens
MATQAKRPRVAGPVDGGDLDPVACFLSWCRRVGLELSPKVAVSRQGTVAGYGMVARESVQAGELLFVVPRAALLSQHTCSIGGLLERERVALQSQSGWVPLLLALLHELQAPASRWRPYFALWPELGRLEHPMFWPEEERRCLLQGTGVPEAVEKDLANIRSEYQSIVLPFMEAHPDLFSLRVRSLELYHQLVALVMAYSFQEPLEEEEDEKEPNSPVMVPAADILNHLANHNANLEYSANCLRMVATQPIPKGHEIFNTYGQMANWQLIHMYGFVEPYPDNTDDTADIQMVTVREAALQGTKTEAERHLVYERWDFLCKLEMVGEEGAFVIGREEVLTEEELTTTLKVLCMPAEEFRELKDQDGGGDDKREEGSLTITNIPKLKASWRQLLQNSVLLTLQTYATDLKTDQGLLSNKEVYAKLSWREQQALQVRYGQKMILHQLLELTS

SEQ ID NO: 800019 - protein, 270 aa, Homo sapiens [sequence omitted]

SEQ ID NO: 800020 - protein, 248 aa, Homo sapiens
MATQAKRPRVAGPVDGGDLDPVACFLSWCRRVGLELSPKVAVSRQGTVAGYGMVARESVQAGELLFVVPRAALLSQHTCSIGGLLERERVALQSQSGWVPLLLALLHELQAPASRWRPYFALWPELGRLEHPMFWPEEERRCLLQGTGVPEAVEKDLANIRSEYQSIVLPFMEAHPDLFSLRVRSLELYHQLVALVMAYSFQEPLEEEEDEKEPNSPVMVPAADILNHLANHNANLEYSAMTQLTFRW

SEQ ID NO: 800021 - protein, 64 aa, Homo sapiens
RRGAHTCVFLRASCAAEPVGLGATAAGAAPRAAGPGLTLEALLCALARAGPLGAPDVLVRALGG

SEQ ID NO: 800022 - protein, 270 aa, Homo sapiens [sequence omitted]

SEQ ID NO: 800023 - protein, 294 aa, Homo sapiens
MATQAKRPRVAGPVDGGDLDPVACFLSWCRRVGLELSPKVSERAGGRRTRGGARAALTSPPAQVAVSRQGTVAGYGMVARESVQAGELLFVVPRAALLSQHTCSIGGLLERERVALQSQSGWVPLLLALLHELQAPASRWRPYFALWPELGRLEHPMFWPEEERRCLLQGTGVPEAVEKDLANIRSEYQSIVLPFMEAHPDLFSLRVRSLELYHQLVALVMAYSFQEPLEEEEDEKEPNSPVMVPAADILNHLANHNANLEYSAVSGVSLGALIEHDSSHCVLGSILLLVLQNE

SEQ ID NO: 800024 - protein, 303 aa, Homo sapiens
RLVRGSFESATRPGEASRVAGPVDGGDLDPVACFLSWCRRVGLELSPKVSERAGGRRTRGGARAALTSPPAQVAVSRQGTVAGYGMVARESVQAGELLFVVPRAALLSQHTCSIGGLLERERVALQSQSGWVPLLLALLHELQAPASRWRPYFALWPELGRLEHPMFWPEEERRCLLQGTGVPEAVEKDLANIRSEYQSIVLPFMEAHPDLFSLRVRSLELYHQLVALVMAYSFQEPLEEEEDEKEPNSPVMVPAADILNHLANHNANLEYSAVSGVSLGALIEHDSSHCVLGSILLLVLQNE

SEQ ID NO: 800025 - protein, 385 aa, Homo sapiens
AKSRGRARDPRPSAPGRTLCAHLFFCMVDIIFHYPFLGAMGDHSKKKPGTAMCVGCGSQIHDQFILRVSPDLEWHAACLKCAECSQYLDETCTCFVRDGKTYCKRDYVRLFGIKCAKCQVGFSSSDLVMRARDSVYHIECFRCSVCSRQLLPGDEFSLREHELLCRADHGLLLERAAAGSPRSPGPLPGARGLHLPDAGSGRQPALRPHVHKQTEKTTRVRTVLNEKQLHTLRTCYAANPRPDALMKEQLVEMTGLSPRVIRVWFQNKRCKDKKKSILMKQLQQQQHSDKTSLQGLTGTPLVAGSPIRHENAVQGSAVEVQTYQPPWKALSEFALQSDLDQPAFQQLVSFSESGSLGNSSGSDVTSLSSQLPDTPNSMVPSPVET

SEQ ID NO: 800026 - protein, 121 aa, Homo sapiens
GRRPSADTAAPWARRLFGIKCAKCQVGFSSSDLVMRARDSVYHIECFRCSVCSRQLLPGDEFSLREHELLCRADHGLLLERAAAGSPRSPGPLPGARGLHLPGKRAGACAGVSGVYVRACV

SEQ ID NO: 800027 - protein, 265 aa, Homo sapiens
CHRCCHYRCHCRCCLCPAEMTVGRPEGAPGGAEGSRQIFPPESFADTEAGEELSGDGLVLPRASKLDEFLSPEEEIDSTSDSTGSIYQNLQELKQKGRWCLLESLFQSDPESDENLSEDEEDLESFFQDKDRGMVQVQCPQALRCGSTRRCSSLNNLPSNIPRPQTQPPSGSRPPSQHRSVSSWASSITVPRPFRMTLREARKKAEWLGSPASFEQERQRAQRQGEEEAECHRQFRAQPVPAHVYLPLYQEIMERSEARRQAGIQ

SEQ ID NO: 800028 - protein, 246 aa, Homo sapiens
MRPLLGLLLVFAGCTFALYLLSTRLPRGRRLGSTEEAGGRSLWFPSDLAELRELSEVLREYRKEHQAYVFLLFCGAYLYKQGFAIPGSSFLNVLAGALFGPWLGLLLCCVLTSVGATCCYLLSSIFGKQLVVSYFPDKVALLQRKVEENRNSLFFFLLFLRLFPMTPNWFLNLSAPILNIPIVQFFFSVLIEARSCYVAQTDLELLTPKVILLPQPPKVLGLQLAQRHLSLHTAHGTLLVREPIRV

SEQ ID NO: 800029 - protein, 264 aa, Homo sapiens
MRPLLGLLLVFAGCTFALYLLSTRLPRGRRLGSTEEAGGRSLWFPSDLAELRELSEVLREYRKEHQAYVFLLFCGAYLYKQGFAIPGSSFLNVLAGALFGPWLGLLLCCVLTSVGATCCYLLSSIFGKQLVVSYFPDKVALLQRKVEENRNSLFFFLLFLRLFPMTPNWFLNLSAPILNIPIVQFFFSVLIGLIPYNFICVQTGSILSTLTSLDALFSWDTVFKLLAIAMVALIPGTLIKKFSQKHLQLNETSTANHIHSRKDT

SEQ ID NO: 800030 - protein, 123 aa, Homo sapiens
RGLSPPAAASRSASELLGCPAGRGAEPTCARFSASFWSSPAAPSPCTCCRRDCPAGGDWAPPRRLEAGRCGSPPTWQSCGSSLRSFESTGRSTRPTCSCSSAAPTSTNRALPSPAPASWFDPI

SEQ ID NO: 800031 - protein, 264 aa, Homo sapiens; identical to SEQ ID NO: 800029

SEQ ID NO: 800032 - protein, 264 aa, Homo sapiens; identical to SEQ ID NO: 800029

SEQ ID NO: 800033 - protein, 247 aa, Homo sapiens
RNHPVSLCNSSGRLQQINKAHHPPWVYLSQQSTWVGPEASNHLHACQGLSGAAMKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYACPLLAPLNDTRVVHAAKAALAAFNAQNNGSNFQLEEISRAQLVIVPPTSTMWGYLFATMCGKRH

SEQ ID NO: 800034 - protein, 420 aa, Homo sapiens
RNHPVSLCNSSGRLQQINKAHHPPWVYLSQQSTWVGPEASNHLHACQGLSGAAMKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCTVFQTQPVTSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 800035 - protein, 247 aa, Homo sapiens
RNHPVSLCNSSGRLQQINKAHHPPWVYLSQQSTWVGPEASNHLHACQGLSGAAMKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVGKD

SEQ ID NO: 800036 - protein, 247 aa, Homo sapiens; identical to SEQ ID NO: 800035

SEQ ID NO: 800037 - protein, 110 aa, Homo sapiens
RNHPVSLCNSSGRLQQINKAHHPPWVYLSQQSTWVGPEASNHLHACQGLSGAAMKSLVLLLCLAQLWGCHSAPHGPGLIYRQPNCDDPETEEAALVAIDYINQTALRRAV

SEQ ID NO: 800038 - protein, 240 aa, Homo sapiens
RNHPVSLCNSSGRLQQINKAHHPPWVYLSQQSTWVGPEASNHLHACQGLSGAAMKSLVLLLCLAQLWGCHSAPHGPGLIYRQPNCDDPETEEAALVAIDYINQNLPWGYKHTLNQIDEVKVWPQQPSGELFEIEIDTLETTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVGKD

SEQ ID NO: 800039 - protein, 484 aa, Homo sapiens
RNHPVSLCNSSGRLQQINKAHHPPWVYLSQQSTWVGPEASNHLHACQGLSGAAMKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYACPLLAPLNDTRVVHAAKAALAAFNAQNNGSNFQLEEISRAQLVDLVMDTCPSYKEDTTPTSKAQALENNNPIATALCKPLRDMSSGPTHGLLNGAPRRRLLPALLLCPFHCKSSFLKSIFMYSSQPLPPSTYVEFTVSGTDCVAKEATEAAKCNLLAEKQYGFCKATLSEKLGGAEVAVTCTVFQTQPVTSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 800040 - protein, 293 aa, Homo sapiens
RNHPVSLCNSSGRLQQINKAHHPPWVYLSQQSTWVGPEASNHLHACQGLSGAAMKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYACPLLAPLNDTRVVHAAKAALAAFNAQNNGSNFQLEEISRAQLVPLPPSTYVEFTVSGTDCVAKEATEAQCTVGKIACRTHKAGAVRRRSAASTVETRGPGTGPCSGAFGG

SEQ ID NO: 800041 - protein, 110 aa, Homo sapiens; identical to SEQ ID NO: 800037

SEQ ID NO: 800042 - protein, 443 aa, Homo sapiens
RNHPVSLCNSSGRLQQINKAHHPPWVYLSQQSTWVGPEASNHLHACQGLSGAAMKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCTVFQTQPVTSQPQPEGANEAVPTPVVDPDAPPSPPLGAPGLPPAGSPPDSHVLLAAPPGHQLHRAHYDLRHTFHGVVSLGSPQEKLLYPGLHVRGGSDTSRSRLDMAEMRRFGTENIATILSKPGHGWGALSAGHASVTCDLH

SEQ ID NO: 800043 - protein, 281 aa, Homo sapiens
RNHPVSLCNSSGRLQQINKAHHPPWVYLSQQSTWVGPEASNHLHACQGLSGAAMKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKRLQ

SEQ ID NO: 800044 - protein, 229 aa, Homo sapiens
RNHPVSLCNSSGRLQQINKAHHPPWVYLSQQSTWVGPEASNHLHACQGLSGAAMKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYACPLLAPLNDTRVVHAAKAALAAFNAQNNGSNFQLEEISRAQLVGKD

SEQ ID NO: 800045 - protein, 402 aa, Homo sapiens
RNHPVSLCNSSGRLQQINKAHHPPWVYLSQQSTWVGPEASNHLHACQGLSGAAMKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYACPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCTVFQTQPVTSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 800046 - protein, 327 aa, Homo sapiens
RPPLLRPETIVEEPEPHGTAVVARGAGRGTMNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREELNSMTLGEVEQLNAKLLQQIQEVFEELTHQVQEKDSLASQLHVRHVAIEQLLKNCSKLPCLQVGRTGMKSHLPINN

SEQ ID NO: 800047 - protein, 122 aa, Homo sapiens
LGAAARPQRRRPGQDPAPRDAEAGRTGRRGPRTLSSLWEESRSDGTRLSRPPGSRMPRLSQLRLGPLRRCPAGTVKPPLGLRCSCPGHGGTPSPGIRYPRAFCCRRSPFDAKLRNSEFARRI

SEQ ID NO: 800048 - protein, 297 aa, Homo sapiens
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREELNSMTLGEVEQLNAKLLQQIQEVFEELTHQVQEKDSLASQLHVRHVAIEQLLKNCSKLPCLQVGRTGMKSHLPINN

SEQ ID NO: 800049 - protein, 104 aa, Homo sapiens
MCLLINTLDTLHPEANVQTQHPHYSREELNSMTLGEVEQLNAKLLQQIQEVFEELTHQVQEKDSLASQLHVRHVAIEQLLKNCSKLPCLQVGRTGMKSHLPINN

SEQ ID NO: 800050 - protein, 251 aa, Homo sapiens
RPPLLRPETIVEEPEPHGTAVVARGAGRGTMNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNKDLDSDSECSKNPQHHLFNFRHKPEEKLLPQFDSQVPKYSAKWIDGSAGGISNCTQRILEQRENTDFGLSMLQDSGATLCRNSVLWPHSHNQAQKKEETISSPEANVQTQHPHYSREE

SEQ ID NO: 800051 - protein, 327 aa, Homo sapiens; identical to SEQ ID NO: 800046

SEQ ID NO: 800052 - protein, 251 aa, Homo sapiens; identical to SEQ ID NO: 800050

SEQ ID NO: 800053 - protein, 275 aa, Homo sapiens
RIMDEKTASELKILYGHSGPVYGASFSPDRNYLLSSSEDGTVRLWSLQTFTCLVGYKGHNYPVWDTQFSPYGYYFVSGGHDRVARLWATDHYQPLRIFAGHLADVNCTRFHPNSNYVATGSADRTVRLWDVLNGNCVRIFTGHKGPIHSLTFSPNGRFLATGATDGRVLLWDIGHGLMVGELKGHTDTVCSLRFSRDGEILASGSMDNTVRLWDAIKAFEDLETDDFTTATGHINLPENSQELLLGTYMTKSTPVVHLHFTRRNLVLAAGAYSPQ

SEQ ID NO: 800054 - protein, 697 aa, Homo sapiens [sequence omitted]

SEQ ID NO: 800055 - protein, 697 aa, Homo sapiens [sequence omitted]

SEQ ID NO: 800056 - protein, 130 aa, Homo sapiens [sequence omitted]

SEQ ID NO: 800057 - protein, 133 aa, Homo sapiens
ALLGKGHLGLPGGGVVLRYRPPGRQPTVPTRASFRCGSALWRPPSKVYKVTRMSAGRGGAAGALPAAASGSLRPSHGRHRKACDKKLMAFNPGRTRKTPSKICINFAALLLGGGGGSSSHLIKFSPSLLPTAL

SEQ ID NO: 800058 - protein, 125 aa, Homo sapiens
ALLGKGHLGLPGGGVVLRYRPPGRQPTVPTRASFRCGSALWRPPSKVYKVTRMSAGRAAASGSLRPSHGRHRKACDKKLMAFNPGRTRKTPSKICINFAALLLGGGGGSSSHLIKFSPSLLPTAL

SEQ ID NO: 800059 - protein, 128 aa, Homo sapiens
QLPVLEHPELGPCRVEAGRSGVGSPRRPQRAPPPAPLTAKEEDSAVSVPSIGGLHHPHLGGQPLPEAVQPCGSAGTPAVPEGWRRQNQGPAGDKGVSQEGMRQQEVSSPRVCGWVGRGPIWKSRAQWI

SEQ ID NO: 800060 - protein, 107 aa, Homo sapiens
RRVPVAAPGSQTLRRLSPAPGDRSPPPPPLRGRSPLLSPRPSPRPWEQTRGLRSASQPPTRSSGGGLGRGGRCSVWMAPPISGRLHPPPAGARGAAGWEQANVLRPG

SEQ ID NO: 800061 - protein, 107 aa, Homo sapiens; identical to SEQ ID NO: 800060

SEQ ID NO: 800062 - protein, 115 aa, Homo sapiens
MHVAAASERELLGNAQRERDREGCSAHGSDLKSVALSRYFENIPKGLDQEGWTRGGIQPQMPGGYALSQPVSCMEATPNPMESLRHLHPHVGRTLTSADPFYQNTPHSSRCVAHS

SEQ ID NO: 800063 - protein, 469 aa, Homo sapiens
THCFSCLASSRRAGFSAELCFLQPLPDLRASAEERPPGALPHSIMMGKLPLGVVSPYVKMSSGGYTDPLKFYATSYCTAYGREDFKPRVGSHVGTGYKSNFQPVVSCQASLEALDNPARGEQAQDHFQSVASQSYRPLEVPDGKHPLPWSMRQTSSGYGREKPSAGPPTKEVRKVHFDTQEHGPQAITGLEPREVPLLHQQQGQDPLERENFRHGPRFMTSEYNSKYLRDPLDQPDFLQKKSIGAKEGSGFTKQSHQSPIVFQPPSQGLPGDPALLPGQSVTKSDFLPKTHLHGDEFLPVLARGSKRETAFSRGNERILNPRVPPPCPEPSSVSHQQFQPLHRMQQTNVALLGRETVGKKEPTGFSLNNPMYVRSPCDPDRDQRYLTTYNQGYFENIPKGLDQEGWTRGGIQPQMPGGYALSQPVSCMEATPNPMESLRHLHPHVGRTLTSADPFYQNTPHSSRCVAHS

SEQ ID NO: 800064 - protein, 469 aa, Homo sapiens; identical to SEQ ID NO: 800063

SEQ ID NO: 800065 - protein, 413 aa, Homo sapiens
THCFSCLASSRRAGFSAELCFLQPLPDLRASAEERPPGALPHSIMMGKLPLGVVSPYVKMSSGGYTDPLKFYATSYCTAYGREDFKPRVGSHVGTGYKSNFQPVVSCQASLEALDNPARGEQAQDHFQSVASQSYRPLEVPDGKHPLPWSMRQTSSGYGREKPSAGPPTKEVRKVHFDTQEHGPQAITGLEPREVPLLHQQQGQDPLERENFRHGVQFQVSQGPSRPARFLAEEIDRRKGGEWLHQTVPPEPHCLPTALTGPPWGPVPPPCPEPSSVSHQQFQPLHRMQQTNVALLGRETVGKKEPTGFSLNNPMYVRSPCDPDRDQRYLTTYNQGYFENIPKGLDQEGWTRGGIQPQMPGGYALSQPVSCMEATPNPMESLRHLHPHVGRTLTSADPFYQNTPHSSRCVAHS

SEQ ID NO: 800066 - protein, 414 aa, Homo sapiens
THCFSCLASSRRAGFSAELCFLQPLPDLRASAEERPPGALPHSIMMGKLPLGVVSPYVKMSSGGYTDPLKFYATSYCTAYGREDFKPRVGSHVGTGYKSNFQPVVSCQASLEALDNPARGEQAQDHFQSVASQSYRPLEVPDGKHPLPWSMRQTSSGYGREKPSAGPPTKEVRKVHFDTQEHGPQAITGLEPREVPLLHQQQGQDPLERENFRHGPRFMTSEYNSKYLRDPLDQPDFLQKKSIGAKEGSGFTKQSHQSPIVFQPPSQGLPGDPALLPGQSVTKSDFLPKTHLHGDEFLPVLARGSKRETAFSRGNERILNPRVPPPCPEPSSVSHQQFQPLHRMQQTNVALLGRETVGKKEPTGFSLNNPMYVRSPCDPDRDQRYLTTYNQGTLTSADPFYQNTPHSSRCVAHS

SEQ ID NO: 800067 - protein, 449 aa, Homo sapiens
THCFSCLASSRRAGFSAELCFLQPLPDLRASAEERPPGALPHSIMMGKLPLGVVSPYVKMSSGGYTDPLKFYATSYCTAYGREDFKPRVGSHVGTGYKSNFQPVVSCQASLEALDNPARGEQAQDHFQSVASQSYRPLEVPDGKHPLPWSMRQTSSGYGREKPSAGPPTKEVRKVHFDTQEHGPQAITGLEPREVPLLHQQQGQDPLERENFRHGPRFMTSEYNSKYLRDPLDQPDFLQKKSIGAKEGSGFTKQSHQSPIVFQPPSQGLPGDPGDEFLPVLARGSKRETAFSRGNERILNPRVPPPCPEPSSVSHQQFQPLHRMQQTNVALLGRETVGKKEPTGFSLNNPMYVRSPCDPDRDQRYLTTYNQGYFENIPKGLDQEGWTRGGIQPQMPGGYALSQPVSCMEATPNPMESLRHLHPHVGRTLTSADPFYQNTPHSSRCVAHS

SEQ ID NO: 800068 - protein, 97 aa, Homo sapiens
RKHSCRKVASLRRTMAELGEADEAELQRLVAAEQQKAQFTAQVHHFMELCWDKCVEKPGNRLDSRTENCLSSCVDRFIDTTLAITSRFAQIVQKGGQ

SEQ ID NO: 800069 - protein, 97 aa, Homo sapiens; identical to SEQ ID NO: 800068

SEQ ID NO: 800070 - protein, 97 aa, Homo sapiens; identical to SEQ ID NO: 800068

SEQ ID NO: 800071 - protein, 79 aa, Homo sapiens
RKHSCRKVASLRRTMAELGEADEAELQRLVAAEQQKAQFTAQATCPEKRYSSTVGFGVAVTPLPHWIVRIICDNVFEND

SEQ ID NO: 800072 - protein, 97 aa, Homo sapiens; identical to SEQ ID NO: 800068

SEQ ID NO: 800073 - protein, 97 aa, Homo sapiens; identical to SEQ ID NO: 800068

SEQ ID NO: 800074 - protein, 79 aa, Homo sapiens; identical to SEQ ID NO: 800071

SEQ ID NO: 800075 - protein, 137 aa, Homo sapiens [sequence omitted]

SEQ ID NO: 800076 - protein, 282 aa, Homo sapiens
MGKQQSSLEGGDRPLSWEESTEHSSLALNSGLPNGETSSGGQPRLAEPDIYQEKLSQVRDVRSKDLGSSTDWGLPALDSWVNITRFCDSQLKHGAPRPGMKSSPHDSHTCVTYPERNHILCIHIGTKTQSRRPQNWSLCIRPVFRLLKLAVLDGGSRIPPGTHFSQTGSADGMGRRLHSAHDPGLSKTSTAEMEHGLHEARTVRTSQATPCRGLSRECGEDEQYSAENLRRISRSLSGTVVSEREEAPVSSHSGDSSNVRKPLETGHRCSSSSYLPVIHDPS

SEQ ID NO: 800077 - protein, 320 aa, Homo sapiens
MGKQQSSLEGGDRPLSWEESTEHSSLALNSGLPNGETSSGGQPRLAEPDIYQEKLSQVRDVRSKDLGSSTDWGLPALDSWVNITRFCDSQLKHGAPRPGMKSSPHDSHTCVTYPERNHILCIHIGTKTQSRRPQNWSLCIRPVFRLLKLAVLDGGSRIPPGTHFSQTGSADGMGRRLHSAHDPGLSKTSTAEMEHGLHEARTVRTSQATPCRGLSRECGEDEQYSAENLRRISRSLSGTVVSEREEAPVSSHSFVSRIRVHLFRAPSSLLSKNTVQVKKQGESEGCNVRKGPVYSAKIRTRSHYFIYKHSAGAQRNVHSM

SEQ ID NO: 800078 - protein, 115 aa, Homo sapiens
MGAVGREGLSSNPRDPRDYSREGARAPRTTVARHQSFTSSVPDFPHHVPKMCLGSTKWGGVGVAESGPGGVGMGSTERCSVCLKTQKSSLVRWYSPVSPEAELGGWLGPRSSRLQ

SEQ ID NO: 800079 - protein, 149 aa, Homo sapiens
MFNKFMECSGISLQYMILLPDQQFPALRNALFCLEAALDSGVTNGYNHAILAYAFALAGKEKQVESLLQTLDQSATKLNNVIYWERERKPKTEEFPSFIPWAPSAQTEKSCYVLLAVISRKIPDLTYASKIVQWLAQQMNSHGGFSSNQ

SEQ ID NO: 800080 - protein, 70 aa, Homo sapiens
HRGKESAFPYRLIVFFIFLILHKSDRTDSVDSTLVPGFIRDIIYQVLQCTTARQILCSDKDHISRELRFM

SEQ ID NO: 800081 - protein, 70 aa, Homo sapiens; identical to SEQ ID NO: 800080

SEQ ID NO: 800082 - protein, 239 aa, Homo sapiens
YSPTSHAPRMPPATGLPEGGPTPPGARDPQSGRWMRPHPMHPSAGDGGVNINSGSHPHPRQDTQCTPQLRDAGSDPGTSEIPATPPVSGSRTSGDTSSASSNPRDGVSLCCPGWSPTPGLKRSACLSLSKGWDNRCKPLHLASNELLCEENVIVEVRGLQPGLNSQGQKWVQPGMTSSKSLAPGLSGAPSSYLPLPSLHSPSHSWLGQPPDISLFANSYSSLKASPSMLSSPRSSLLYL

SEQ ID NO: 800083 - protein, 536 aa, Homo sapiens
EFGTSGTSFTSSTRSRDFCCSEAIQGSLTRRERRASGVRTRRSQGSSAMASKILLNVQEEVTCPICLELLTEPLSLDCGHSLCRACITVSNKEAVTSMGGKSSCPVCGISYSFEHLQANQHLANIVERLKEVKLSPDNGKKRDLCDHHGEKLLLFCKEDRKVICWLCERSQEHRGHHTVLTEEVFKECQEKLQAVLKRLKKEEEEAEKLEADIREEKTSWKYQVQTERQRIQTEFDQLRSILNNEEQRELQRLEEEEKKTLDKFAEAEDELVQQKQLVRELISDVECRSQWSTMELLQDMSGIMKWSEIWRLKKPKMVSKKLKTVFHAPDLSRMLQMFRELTAVRCYWVDVTLNSVNLNLNLVLSEDQRQVISVPIWPFQCYNYGVLGSQYFSSGKHYWEVDVSKKTAWILGVYCRTYSRHMKYVVRRCANRQNLYTKYRPLFGYWVIGLQNKCKYGVFEESLSSDPEVLTLSMAVPPCRVGVFLDYEAGIVSFFNVTSHGSLIYKFSKCCFSQPVYPYFNPWNCPAPMTLCPPSS

SEQ ID NO: 800084 - protein, 488 aa, Homo sapiens
MASKILLNVQEEVTCPICLELLTEPLSLDCGHSLCRACITVSNKEAVTSMGGKSSCPVCGISYSFEHLQANQHLANIVERLKEVKLSPDNGKKRDLCDHHGEKLLLFCKEDRKVICWLCERSQEHRGHHTVLTEEVFKECQEKLQAVLKRLKKEEEEAEKLEADIREEKTSWKYQVQTERQRIQTEFDQLRSILNNEEQRELQRLEEEEKKTLDKFAEAEDELVQQKQLVRELISDVECRSQWSTMELLQDMSGIMKWSEIWRLKKPKMVSKKLKTVFHAPDLSRMLQMFRELTAVRCYWVDVTLNSVNLNLNLVLSEDQRQVISVPIWPFQCYNYGVLGSQYFSSGKHYWEVDVSKKTAWILGVYCRTYSRHMKYVVRRCANRQNLYTKYRPLFGYWVIGLQNKCKYGVFEESLSSDPEVLTLSMAVPPCRVGVFLDYEAGIVSFFNVTSHGSLIYKFSKCCFSQPVYPYFNPWNCPAPMTLCPPSS

SEQ ID NO: 800085 - protein, 243 aa, Homo sapiens
MELLQDMSGIMKWSEIWRLKKPKMVSKKLKTVFHAPDLSRMLQMFRELTAVRCYWVDVTLNSVNLNLNLVLSEDQRQVISVPIWPFQCYNYGVLGSQYFSSGKHYWEVDVSKKTAWILGVYCRTYSRHMKYVVRRCANRQNLYTKYRPLFGYWVIGLQNKCKYGVFEESLSSDPEVLTLSMAVPPCRVGVFLDYEAGIVSFFNVTSHGSLIYKFSKCCFSQPVYPYFNPWNCPAPMTLCPPSS

SEQ ID NO: 800086 - protein, 372 aa, Homo sapiens
MCGSERILQAGNILEIRVGQAGARRVATMTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRGEMKWPGDILTGFLTIPLNVVRREIPDMRQLVLFNIIDSFHHYRADRCPKLLG

SEQ ID NO: 800087 - protein, 488 aa, Homo sapiens; identical to SEQ ID NO: 800084

SEQ ID NO: 800088 - protein, 388 aa, Homo sapiens
ESFGLGGGRGCFKSLALIQATDSRFYQAGNFSSASRAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 800089 - protein, 349 aa, Homo sapiens
MASKILLNVQEEVTCPICLELLTEPLSLDCGHSLCRACITVSNKEAVTSMGGKSSCPVCGISYSFEHLQANQHLANIVERLKEVKLSPDNGKKRDLCDHHGEKLLLFCKEDRKVICWLCERSQEHRGHHTVLTEEVFKECQEKLQAVLKRLKKEEEEAEKLEADIREEKTSWKYQVQTERQRIQTEFDQLRSILNNEEQRELQRLEEEEKKTLDKFAEAEDELVQQKQLVRELISDVECRSQWSTMELLQDMSGIMKWSEIWRLKKPKMVSKKLKTVFHAPDLSRMLQMFRELTAVRCYWVDVTLNSVNLNLNLVLSEDQRQVISVPIWPFQCYNYGVLGSQYFSLMFP

SEQ ID NO: 800090 - protein, 270 aa, Homo sapiens
MASKILLNVQEEVTCPICLELLTEPLSLDCGHSLCRACITVSNKEAVTSMGGKSSCPVCGISYSFEHLQANQHLANIVERLKEVKLSPDNGKKRDLCDHHGEKLLLFCKEDRKVICWLCERSQEHRGHHTVLTEEVFKECQEKLQAVLKRLKKEEEEAEKLEADIREEKTSWKYQVQTERQRIQTEFDQLRSILNNEEQRELQRLEEEEKKTLDKFAEAEDELVQQKQLVRELISDVECRSQWSTMELLQDMSGIMKWCVWVATSGACEL

SEQ ID NO: 800091 - protein, 273 aa, Homo sapiens
MASKILLNVQEEVTCPICLELLTEPLSLDCGHSLCRACITVSNKEAVTSMGGKSSCPVCGISYSFEHLQANQHLANIVERLKEVKLSPDNGKKRDLCDHHGEKLLLFCKEDRKVICWLCERSQEHRGHHTVLTEEVFKECQEKLQAVLKRLKKEEEEAEKLEADIREEKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTS

SEQ ID NO: 800092 - protein, 842 aa, Homo sapiens
MCGSERILQAGNILEIRVGQAGARRVATMTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWAIQGSLTRRERRASGVRTRRSQGSSAMASKILLNVQEEVTCPICLELLTEPLSLDCGHSLCRACITVSNKEAVTSMGGKSSCPVCGISYSFEHLQANQHLANIVERLKEVKLSPDNGKKRDLCDHHGEKLLLFCKEDRKVICWLCERSQEHRGHHTVLTEEVFKECQEKLQAVLKRLKKEEEEAEKLEADIREEKTSWKYQVQTERQRIQTEFDQLRSILNNEEQRELQRLEEEEKKTLDKFAEAEDELVQQKQLVRELISDVECRSQWSTMELLQDMSGIMKWSEIWRLKKPKMVSKKLKTVFHAPDLSRMLQMFRELTAVRCYWVDVTLNSVNLNLNLVLSEDQRQVISVPIWPFQCYNYGVLGSQYFSSGKHYWEVDVSKKTAWILGVYCRTYSRHMKYVVRRCANRQNLYTKYRPLFGYWVIGLQNKCKYGVFEESLSSDPEVLTLSMAVPPCRVGVFLDYEAGIVSFFNVTSHGSLIYKFSKCCFSQPVYPYFNPWNCPAPMTLCPPSS

SEQ ID NO: 800093 - protein, 534 aa, Homo sapiens
ESFGLGGGRGCFKSLALIQATDSRILQAGNILEIRVGQAGARRVATMTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 800094 - protein, 169 aa, Homo sapiens
MEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRGEMKWPGDILTGFLTIPLNVVRREIPDMRQLVLFNIIDSFHHYRADRCPKLLG

SEQ ID NO: 800095 - protein, 535 aa, Homo sapiens
MCGSERILQAGNILEIRVGQAGARRVATMTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRELTDVQSYWAYTRPMSPFSSADVVPFPTVDVTLNPHTANLNLVLAKNRRQVRFVGAKVSGPSCLEKHYDCSVLGSQHFSSGKHYWEVDVAKKTAWILGVCSNSLGPTFSFNHFAQNHSAYSRYQPQSGYWVIGLQHNHEYRAYEDSSPSLLLSMTVPPRRVGVFLDYEAGTVSFYNVTNHGFPIYTFSKYYFPTTLCPYFNPCNCVIPMTLRRPSS

SEQ ID NO: 800096 - protein, 387 aa, Homo sapiens
MCGSERILQAGNILEIRVGQAGARRVATMTSPVLVDIREEVTCPICLELLTEPLSIDCGHSFCQACITPNGRESVIGQEGERSCPVCQTSYQPGNLRPNRHLANIVRRLREVVLGPGKQLKAVLCADHGEKLQLFCQEDGKVICWLCERSQEHRGHHTFLVEEVAQEYQEKFQESLKKLKNEEQEAEKLTAFIREKKTSWKNQMEPERCRIQTEFNQLRNILDRVEQRELKKLEQEEKKGLRIIEEAENDLVHQTQSLRELISDLERRCQGSTMELLQDVSDVTERSEFWTLRKPEALPTKLRSMFRAPDLKRMLRVCRGEMKWPGDILTGFLTIPLNVVRREIPDMRQLVLFNIIDSFHHYRADRCPKLLGHPGVFNQKREESLRS

SEQ ID NO: 800097 - protein, 349 aa, Homo sapiens; identical to SEQ ID NO: 800089

SEQ ID NO: 800098 - protein, 349 aa, Homo sapiens; identical to SEQ ID NO: 800089

SEQ ID NO: 800099 - protein, 535 aa, Homo sapiens; identical to SEQ ID NO: 800095

SEQ ID NO: 800100 - protein, 191 aa, Homo sapiens
LGVPRPQVPGAPAPRPSGCNISAQRSFCEHPGVVATASPPPTQQDSPRTGPHSQSAGSAPQQRSREPEDPGTRGGGGGRAAAALRAWGRPRSADALFRGWGVKSLWLFRHGVNGNTWAAATLRAFWPRRAAGNRSDARARPFCVLAVSPVPKPEAWERSNWENGARLVNSFRSSETMSWILDLNVLAERGL

SEQ ID NO: 800101 - protein, 201 aa, Homo sapiens
LGVPRPQVPGAPAPRPSGCNISAQRSFCEHPGVVATASPPPTQQDSPRTGPHSQSAGSAPQQRSREPEDPGTRGGGGGRAAAALRAWGRPRSADALFRGWGVKSLWLFRHGVNGNTWAAATLRAFWPRRAAGNRSDARARPFCVLAVSPVPKPEAWERSNWENGARLVNSFRSSETMSWILDLNVLAERGLAFIENLLCLG

SEQ ID NO: 800102 - protein, 1798 aa, Homo sapiens
MARGSARLAGVPRIPGSGVPGSRVGGRSAQGPRLGPEARVPAQAGSRLPGAHPRAPGAWLPSGARPRPASLAGVGVAGEGAESPGSCLVPEARPSPAVAPARVAESPDARRPLPAAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTAQSGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTVTGPWLRVGVGLLLMHADSWKGLGFLKLQLHVTLGPCSVSSLWWGSLHSGVHAAPVPCTKTTTSSSHFTSRLFGHRSRFKPAFTHLASFSLLVMRLEDFHVAEPLQLTHAWASMAPPHSRSTRHLGGGTFLNIFFLRESLVLSPRLECSGAIIAHCSLDPLPDLPASWTPAILLPQLPRYLGHRRVPPHLANFFFFFFLRWHLALSPRMECSGAILAHCKLRLPGSHHSPASASPVAGTTGACQHAWLIFFFCIFSRDEAFTLLARMVSRFVFLTFCRDRVSLHCSGWSQTPGLKQSSHLSLPKCWDHRHEPLCPATSCFLSTFRLAGGFVLLCEWVAVLSIAGLCRSPKASGGEDGGAGFLPLSTAARSEAGLRMREKPPPGGARLGLAESRWPRLALPCGLSLGLLQMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAGDAVGTLSQLRESLAWMLGRGRPSPRGSAVSRPGSWLHRVPRGQVAYPEPWGGRCQGGPRGSLTEGPGGTWVVCEAPQPGSRLAKSGGLEGAASCSRVEPGTLSSRECICWGVGDPKPEHAAHPGVALEAPDPTPPTEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKGTCPPPASGGWLRLKAVVGYSGNGRANMVWRPDTGFFAYTCGR

SEQ ID NO: 800103 - protein, 1140 aa, Homo sapiens
MARAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTAQSGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKGTCPPPASGGWLRLKAVVGYSGNGRANMVWRPDTGFFAYTCGR

SEQ ID NO: 800104 - protein, 1223 aa, Homo sapiens
MARGSARLAGVPRIPGSGVPGSRVGGRSAQGPRLGPEARVPAQAGSRLPGAHPRAPGAWLPSGARPRPASLAGVGVAGEGAESPGSCLVPEARPSPAVAPARVAESPDARRPLPAAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTAQSGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKALGHRWPCWAPAAS

SEQ ID NO: 800105 - protein, 831 aa, Homo sapiens
MREKPPPGGARLGLAESRWPRLALPCGLSLGLLQMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAGDAVGTLSQLRESLAWMLGRGRPSPRGSAVSRPGSWLHRVPRGQVAYPEPWGGCCQGGPRGSLTEGPGGTWVVCEAPQPGSRLAKSGGLEGAASCSRVEPGTLSSRECICWGVGDPKPEHAAHPGVALEAPDPTPPTEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKGTCPPPASGGWLRLKAVVGYSGNGRANMVWRPDTGFFAYTCGR

SEQ ID NO: 800106 - protein, 141 aa, Homo sapiens
WPPDGTLWWPPADLPSPLTQQLPLMRAPRACAPPGPGTVPTAPTPPTPASPSAPGCPLQLAWVCPNTASHVQALGHRWPCWAPAASGSPSSQGTCPPPASGGWLRLKAVVGYSGNGRANMVWRPDTGGGQEPTPTPSQDAA

SEQ ID NO: 800107 - protein, 1252 aa, Homo sapiens
MARGSARLAGVPRIPGSGVPGSRVGGRSAQGPRLGPEARVPAQAGSRLPGAHPRAPGAWLPSGARPRPASLAGVGVAGEGAESPGSCLVPEARPSPAVAPARVAESPDARRPLPAAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTAQSGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKGTCPPPASGGWLRLKAVVGYSGNGRANMVWRPDTGFFAYTCGR

SEQ ID NO: 800108 - protein, 1259 aa, Homo sapiens
MARGSARLAGVPRIPGSGVPGSRVGGRSAQGPRLGPEARVPAQAGSRLPGAHPRAPGAWLPSGARPRPASLAGVGVAGEGAESPGSCLVPEARPSPAVAPARVAESPDARRPLPAAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTAQSGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGARDTRNSGAPRTTYLASCKAFTPARVSCSPHSAKGTCPPPASGGWLRLKAVVGYSGNGRANMVWRPDTGGGQEPTPTPSQDAAA

SEQ ID NO: 800109 - protein, 1224 aa, Homo sapiens
MARGSARLAGVPRIPGSGVPGSRVGGRSAQGPRLGPEARVPAQAGSRLPGAHPRAPGAWLPSGARPRPASLAGVGVAGEGAESPGSCLVPEARPSPAVAPARVAESPDARRPLPAAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTAQSGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVWDYATQASPGPQVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGHLPASRQRWVAASEGCRRLQREWAGQHGLEAGHRWGPRAYPHPQPRCGR

SEQ ID NO: 800110 - protein, 1205 aa, Homo sapiens
MARGSARLAGVPRIPGSGVPGSRVGGRSAQGPRLGPEARVPAQAGSRLPGAHPRAPGAWLPSGARPRPASLAGVGVAGEGAESPGSCLVPEARPSPAVAPARVAESPDARRPLPAAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPLPCPVASSKPVRFSVSPVVQTPSPTAQSGRAALAPRPFPEVSLSQERSDASNADGPGFHSLEPWAQLEASDIHTAAAGTHVLTHESAEVPVARTGSCEGFLPDPVLRLKGVIGFGGHGTRQALWTPDGAAVVYPCHAVIVVLLVDTGEQRFFLGHTDKVSALALDGSSSLLASAQARAPSVMRLWDFQTGRCLCLFRSPMHVVCSLSFSDSGALLCGVGKDHHGRTMVVAWGTGQVGLGGEVVVLAKAHTDFDVQAFRVTFFDETRMASCGQGSVRLWRLRGGVLRSCPVDLGEHHALQFTDLAFKQARDGCPEPSAAMLFVCSRSGHILEIDCQRMVVRHARRLLPTRTPGGPHPQKQTFSSGPGIAISSLSVSPAMCAVGSEDGFLRLWPLDFSSVLLEAEHEGPVSSVCVSPDGLRVLSATSSGHLGFLDTLSRVYHMLARSHTAPVLALAMEQRRGQLATVSQDRTVRIWDLATLQQLYDFTSSEDAPCAVTFHPTRPTFFCGFSSGAVRSFSLEAAEVLVEHTCHRGAVTGLTATPDGRLLFSSCSQGSLAQYSCADPQWHVLRVAADMVCPDAPASPSALAVSRDGRLLAFVGPSRCTVTVMGSASLDELLRVDIGTLDLASSRLDSAMAVCFGPAALGHLLVSTSSNRVVVLDAVSGRIIRELPGVHPEPCPSLTLSEDARFLLIAAGRTIKVYIGHSEPVQAVAFSPDQQQVLSAGDAVFLWDVLAPTESDQSFPGAPPACKTGPGAGPLEDAASRASELPRQQVPKPCQASPPRLGVCARPPEGGDGHLPASRQRWVAASEGCRRLQREWAGQHGLEAGHRLLCLHVRPP

SEQ ID NO: 800111 - protein, 55 aa, Homo sapiens
GRPGACGETACSVGSLKSSGQCNATSSASSLPGARDTRNSGAPRTTYLASCKAFT

SEQ ID NO: 800112 - protein, 740 aa, Homo sapiens
MQWTKVLGLGLGAAALLGLGIILGHFAIPKKANSLAPQDLDLEILETVMGQLDAHRIRENLRELSREPHLASSPRDEDLVQLLLQRWKDPESGLDSAEASTYEVLLSFPSQEQPNVVDIVGPTGGIIHSCHRTEENVTGEQGGPDVVQPYAAYAPSGTPQGLLVYANRGAEEDFKELQTQGIKLEGTIALTRYGGVGRGAKAVNAAKHGVAGVLVYTDPADINDGLSSPDETFPNSWYLPPSGVERGSYYEYFGDPLTPYLPAVPSSFRVDLANVSGFPPIPTQPIGFQDARDLLCNLNGTLAPATWQGALGCHYRLGPGFRPDGDFPADSQVNVSVYNRLELRNSSNVLGIIRGAVEPDRYVLYGNHRDSWVHGAVDPSSGTAVLLELSRVLGTLLKKGTWRPRRSIVFASWGAEEFGLIGSTEFTEEFFNKLQERTVAYINVDISVFANATLRVQGTPPVQSVVFSATKEIRSPGPGDLSIYDNWIRYFNRSSPVYGLVPSLGSLGAGSDYAPFVHFLGISSMDIAYTYDRSKTSARIYPTYHTAFDTFDYVDKFLDPGFSSHQAVARTAGSVILRLSDSFFLPLKVSDYSETLRSFLQAAQQDLGALLEQHSISLGPLVTAVEKFEAEAAALGQRISTLQKGSPDPLQVRMLNDQLMLLERTFLNPRAFPEERYYSHVLWAPRTGSVVTFPGLSNACSRARDTASGSEAWAEVQRQLSIVVTALEGAAATLRPVADL

SEQ ID NO: 800113 - protein, 240 aa, Homo sapiens
MWTSFWTRVRRETRGILRPGQERLKTEPWPCHLAAGFSSHQAVARTAGSVILRLSDSFFLPLKVSDYSETLRSFLQAAQQDLGALLEQHSISLGMHSPDPEVWGALHPHELSHCLFLTGPLVTAVEKFEAEAAALGQRISTLQKGSPDPLQVRMLNDQLMLLERTFLNPRAFPEERYYSHVLWAPRTGSVVTFPGLSNACSRARDTASGSEAWAEVQRQLSIVVTALEGAAATLRPVADL

SEQ ID NO: 800114 - protein, 339 aa, Homo sapiens
PPHVSSLSPEGTLGSGGPCPPTLYPPFPGTWRPRRSIVFASWGAEEFGLIGSTEFTEEFFNKLQERTVAYINVDISVFANATLRVQGTPPVQSVVFSATKEDPLTRPWRPEHLRQLDPVLQPQQPGVRPGPQSKTSARIYPTYHTAFDTFDYVDKFLDPGFSSHQAVARTAGSVILRLSDSFFLPLKVSDYSETLRSFLQAAQQDLGALLEQHSISLGPLVTAVEKFEAEAAALGQRISTLQKGSPDPLQVRMLNDQLMLLERTFLNPRAFPEERYYSHVLWAPRTGSVVTFPGLSNACSRARDTASGSEAWAEVQRQLSIVVTALEGAAATLRPVADL

SEQ ID NO: 800115 - protein, 110 aa, Homo sapiens [sequence omitted]

SEQ ID NO: 800116 - protein, 339 aa, Homo sapiens; identical to SEQ ID NO: 800114

SEQ ID NO: 800117 - protein, 110 aa, Homo sapiens [sequence omitted]

SEQ ID NO: 800118 - protein, 522 aa, Homo sapiens
MQWTKVLGLGLGAAALLGLGIILGHFAIPKKANSLAPQDLDLEILETVMGQLDAHRIRENLRELSREPHLASSPRDEDLVQLLLQRWKDPESGLDSAEASTYEVLLSFPSQEQPNVVDIVGPTGGIIHSCHRTEENVTGEQGGPDVVQPYAAYAPSGTPQGLLVYANRGAEEDFKELQTQGIKLEGTIALTRYGGVGRGAKAVNAAKHGVAGVLVYTDPADINDGLSSPDETFPNSWYLPPSGVERGSYYEYFGDPLTPYLPAVPSSFRVDLANVSGFPPIPTQPIGFQDARDLLCNLNGTLAPATWQGALGCHYRLGPGFRPDGDFPADSQVNVSVYNRLELRNSSNVLGIIRGAVEPDRYVLYGNHRDSWVHGAVDPSSGTAVLLELSRVLGTLLKKGTWRPRRSIVFASWGAEEFGLIGSTEFTEEFFNKLQERTVAYINVDISVFANATLRVQGTPPVQSVVFSATKEIRSPGPGDLSIYDNWIRYFNRSSPVYGLVPRLQQPSGCGPDSGECDSPAQ

SEQ ID NO: 800119 - protein, 468 aa, Homo sapiens
MPPWGAALALILAVLALLGLLGPRLRGPWGRAVGERTLPGAQDRDDGEEADGGGPADQFSDGREPLPGGCSLVCKPSALAQCLLRALRRSEALEAGPRSWFSGPHLQTLCHFVLPVAPGPELAREYLQLADDGLVALDWVVGPCVRGRRITSAGGLPAVLLVIPNAWGRLTRNVLGLCLLALERGYYPVIFHRRGHHGCPLVSPRLQPFGDPSDLKEAVTYIRFRHPAAPLFAVSEGSGSALLLSYLGECGSSSYVTGAACISPVLRCREWFEAGLPWPYERGFLLHQKIALSRYATALEDTVDTSRLFRSRSLREFEEALFCHTKSFPISWDAYWDRNDPLRDVDEAAVPVLCICSADDPVCGPPDHTLTTELFHSNPYFFLLLSRHGGHCGFLRQEPLPAWSHEVILESFRALTEFFRTEERIKGLSRHRASFLGGRRRGGALQRREVSSSSNLEEIFNWKRSYTR

SEQ ID NO: 800120 - protein, 149 aa, Homo sapiens
TAIAKFVRVGRLYENTRRIEQGALQVSARNGADLAPKPHWRDPKGILQIGSALMQDLRALLDHGSRSQNLGYPTCSLWHHFRGLLQRAAARTVYLLRYGLSLSQEKHKPHNLGVFWLVAPFSDPTTGLSLSRARRHIWDQRKQKHQEVD

SEQ ID NO: 800121 - protein, 113 aa, Homo sapiens
VSPRLQPFGDPSDLKEAVTYIRFRHPAAPLFAVSEGSGSALLLSYLGECGSSSYVTGAACISPVLRCREWFEAGLPWPYERGFLLHQKIALSRWVTEAADQHGKNRGPELAKN

SEQ ID NO: 800122 - protein, 468 aa, Homo sapiens; identical to SEQ ID NO: 800119

SEQ ID NO: 800123 - protein, 468 aa, Homo sapiens; identical to SEQ ID NO: 800119

SEQ ID NO: 800124 - protein, 468 aa, Homo sapiens; identical to SEQ ID NO: 800119

SEQ ID NO: 800125 - protein, 121 aa, Homo sapiens [sequence omitted]

SEQ ID NO: 800126 - protein, 121 aa, Homo sapiens [sequence omitted]

SEQ ID NO: 800127 - protein, 121 aa, Homo sapiens [sequence omitted]

SEQ ID NO: 800128 - protein, 121 aa, Homo sapiens [sequence omitted]

SEQ ID NO: 800129 - protein, 74 aa, Homo sapiens
RAAGSAHAAECGTGAPGCGCGTEASAGAARLEGVEREPTTRFASLRPARRLLHTCRSHAGGLDIEGREVDLGDI

SEQ ID NO: 800130 - protein, 71 aa, Homo sapiens
RAAGSAHAAECGTGAPGCGCGTEASAGAARLEGVERETGDINICKMNVGSLGKGGTTRSREGASRSQRAYD

SEQ ID NO: 800131 - protein, 129 aa, Homo sapiens
MASPEHPGSPGCMGPITQCTARTQQEAPATGPDLPHPGPDGHLDTHSGLSSNSSMTTRELQQYWQNQKCRWKHVKLLFEIASARIEERKVSKFVMGKSRPGEMTYPGSRGETGTAPEPDPRCPRQSDML

SEQ ID NO: 800132 - protein, 316 aa, Homo sapiens
MASPEHPGSPGCMGPITQCTARTQQEAPATGPDLPHPGPDGHLDTHSGLSSNSSMTTRELQQYWQNQKCRWKHVKLLFEIASARIEERKVSKFVVYQIIVIQTGSFDNNKAVLERRYSDFAKLQKALLKTFREEIEDVEFPRKHLTGNFAEEMICERRRALQEYLGLLYAIRCVRRSREFLDFLTRPELREAFGCLRAGQYPRALELLLRVLPLQEKLTAHCPAAAVPALCAVLLCHRDLDRPAEAFAAGERALQRLQAREGHRYYAPLLDAMVRLAYALGKDFVTLQERLEESQLRRPTPRGITLKELTVREYLH

SEQ ID NO: 800133 - protein, 102 aa, Homo sapiens
MASPEHPGSPGCMGPITQCTARTQQEAPATGPDLPHPGPDGHLDTHSGLSSNSSMTTRELQQYWQNQKCRWKHVKLLFEIASARIEERKVSKFVAPAPDATP

SEQ ID NO: 800134 - protein, 161 aa, Homo sapiens
QGMLYTGLVNFTLGVLRPPQPPPGGGHSSLWLRPEVYQIIVIQTGSFDNNKAVLERRYSDFAKLQKALLKTFREEIEDVEFPRKHLTGNFAEEMICERRRALQEYLGLLYAIRCVRRSREFLDFLTRPELREAFGCLRAGQYPRALELLLRVLPLQEKLTA

SEQ ID NO: 800135 - protein, 175 aa, Homo sapiens
PPPEAPGEKRGRREGRSLWRKMAAAWGSSLTAATQRAVTPWPRGRLLTASLGPQARREASSSSPEAGEGQIRLTDSCVQRLLEITEGSEFLRLQVEGGGCSGFQYKFSLDTVINPDDRVFEQGGARVVVDSDSLAFVKGAQVDFSQELIRSSFQVLNNPQAQQGCSCGSSFSIKL

SEQ ID NO: 800136 - protein, 120 aa, Homo sapiens
PPPEAPGEKREETRGAELVEEDGCRLGVVPNGRDAESGHSLAEGQSGFQYKFSLDTVINPDDRVFEQGGARVVVDSDSLAFVKGAQVDFSQELIRSSFQVLNNPQAQQGCSCGSSFSIKL

SEQ ID NO: 800137 - protein, 175 aa, Homo sapiens; identical to SEQ ID NO: 800135

SEQ ID NO: 800138 - protein, 175 aa, Homo sapiens; identical to SEQ ID NO: 800135

SEQ ID NO: 800139 - protein, 175 aa, Homo sapiens; identical to SEQ ID NO: 800135

SEQ ID NO: 800140 - protein, 466 aa, Homo sapiens
MLLGGPPRSPRSGTSPKGPWSSTGHVQFGKSPQTWPRRTRPRSPEPAAPSGVRGSTWTRRRDSPRRAGPTALSRYVGHLWMGRRPPSPEARGPVPRSSAASRARRSLASPGISPGPLTATIGGAVAGGGPRQGRAEAHKEVFPGQRVGKMAAPMELFCWSGGWGLPSVDLDSLAVLTYARFTGAPLKVHKISNPWQSPSGTLPALRTSHGEVISVPHKIITHLRKEKYNADYDLSARQGADTLAFMSLLEEKLLPVLVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 800141 - protein, 435 aa, Homo sapiens
MLLGGPPRSPRSGTSPKGPWSSTGHVQFGKSPQTWPRRTRPRSPEPAAPSGVRGSTWTRRRDSPRRAGPTALSRYVGHLWMGRRPPSPEARGPVPRSSAASRARRSLASPGISPGPLTATIGGAVAGGGPRQGRAEAHKEVFPGQRVGKMAAPMELFCWSGGWGLPSVDLDSLAVLTYARFTGAPLKVHKISNPWQSPSGTLPALRTSHGEVISVPHKIITHLRKEVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 800142 - protein, 466 aa, Homo sapiens; identical to SEQ ID NO: 800140

SEQ ID NO: 800143 - protein, 253 aa, Homo sapiens
MWRGMLRNRDWSLKYNADYDLSARQGADTLAFMSLLEEKLLPVLVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 800144 - protein, 253 aa, Homo sapiens; identical to SEQ ID NO: 800143

SEQ ID NO: 800145 - protein, 236 aa, Homo sapiens
MLLGGPPRSPRSGTSPKGPWSSTGHVQFGKSPQTWPRRTRPRSPEPAAPSGVRGSTWTRRRDSPRRAGPTALSRYVGHLWMGRRPPSPEARGPVPRSSAASRARRSLASPGISPGPLTATIGGAVAGGGPRQGRAEAHKEVFPGQRVGKMAAPMELFCWSGGWGLPSVDLDSLAVLTYARFTGAPLKVHKISNPWQSPSGTLPALRTSHGEVISVPHKIITHLRKEVGDLDRGGCQ

SEQ ID NO: 800146 - protein, 362 aa, Homo sapiens
MRFIEQYLMELNTLSISESEGPRKEKYNADYDLSAQQGADTLAFMSLLEEKLIPVLVSVPRPPSIHGQPGRGREHTDPHRDSGEHGGQKPTLNQTGALAQTCLFLPAHPIQVHTFWIDTKNYVEVTRKWYAEAMPFPLNFFLPGRMQRQYMERLQLLTGEHRPEDEEELEKEVALRPGAIVGDEPQGCWPGMGVLRCRGGTVPAAASLPVSPLQLYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 800147 - protein, 236 aa, Homo sapiens; identical to SEQ ID NO: 800145

SEQ ID NO: 800148 - protein, 236 aa, Homo sapiens
AARHRKGLKSCGALSVPFMQPWIEPYSGPAGATWGSLPIPGLELCVLSFPGGRLLPRAHLPRLTLPPAPSLPLLPQWFSSIPPFSLCSSPASLDAFVFSYLALLLQAKLPSGKLQVHLRGLHNLCAYCTHILSLYFPWDGGKGQMGGAALGRVGRDPRTSSPNTPSFLDPPAEVPPQRQTPAGPETEEEPYRRRNQILSVLAGLAAMVGYALLSGIVSIQRATPARAPGTRTLGMA

SEQ ID NO: 800149 - protein, 71 aa, Homo sapiens
AEVPPQRQTPAGPETEEEPYRRRNQILSVLAGLAAMVGYALLSGIVSIQRATPARAPGTRTLGMAEEDEEE

SEQ ID NO: 800150 - protein, 466 aa, Homo sapiens; identical to SEQ ID NO: 800140

SEQ ID NO: 800151 - protein, 473 aa, Homo sapiens
MLLGGPPRSPRSGTSPKGPWSSTGHVQFGKSPQTWPRRTRPRSPEPAAPSGVRGSTWTRRRDSPRRAGPTALSRYVGHLWMGRRPPSPEARGPVPRSSAASRARRSLASPGISPGPLTATIGGAVAGGGPRQGRAEAHKEVFPGQRVGKMAAPMELFCWSGGWGLPSVDLDSLAVLTYARFTGAPLKVHKISNPWQSPSGTQYPFGGTLPALRTSHGEVISVPHKIITHLRKEKYNADYDLSARQGADTLAFMSLLEEKLLPVLVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 800152 - protein, 236 aa, Homo sapiens; identical to SEQ ID NO: 800145

SEQ ID NO: 800153 - protein, 181 aa, Homo sapiens
MRFIEQYLMELNTLSISESEGPRKEKYNADYDLSAQQGADTLAFMSLLEEKLIPVLVSVPRPPSIHGQPGRGREHTDPHRDSGEHGGQKPTLNQTGALAQTCLFLPAHPIQVHTFWIDTKNYVEVTRKWYAEAMPFPLNFFLPGRMQRQYMERLQLLTGEHRPEDEEELEKEVALRPGAIV

SEQ ID NO: 800154 - protein, 1183 aa, Homo sapiens
MQLLQLLLGLLGPGGYLFLLGDCQEVTTLTVKYQVSEEVPSGTVIGKLSQELGREERRRQAGAAFQVLQLPQALPIQVDSEEGLLSTGRRLDREQLCRQWDPCLVSFDVLATGDLALIHVEIQVLDINDHQPRFPKGEQELEISESASLRTRIPLDRALDPDTGPNTLHTYTLSPSEHFALDVIVGPDETKHAELIVVKELDREIHSFFDLVLTAYDNGNPPKSGTSLVKVNVLDSNDNSPAFAESSLALEIQEDAAPGTLLIKLTATDPDQGPNGEVEFFLSKHMPPEVLDTFSIDAKTGQVILRRPLDYEKNPAYEVDVQARDLGPNPIPAHCKVLIKVLDVNDNIPSIHVTWASQPSLVSEALPKDSFIALVMADDLDSGHNGLVHCWLSQELGHFRLKRTNGNTYMLLTNATLDREQWPKYTLTLLAQDQGLQPLSAKKQLSIQISDINDNAPVFEKSRYEVSTRENNLPSLHLITIKAHDADLGINGKVSYRIQDSPVAHLVAIDSNTGEVTAQRSLNYEEMAGFEFQVIAEDSGQPMLASSVSVWVSLLDANDNAPEVVQPVLSDGKASLSVLVNASTGHLLVPIETPNGLGPAGTDTPPLATHSSRPFLLTTIVARDADSGANGEPLYSIRSGNEAHLFILNPHTGQLFVNVTNASSLIGSEWELEIVVEDQGSPPLQTRALLRVMFVTSVDHLRDSARKPGALSMSMLTVICLAVLLGIFGLILALFMSICRTEKKDNRAYNCREAESTYRQQPKRPQKHIQKADIHLVPVLRGQAGEPCEVGQSHKDVDKEAMMEAGWDPCLQAPFHLTPTLYRTLRNQGNQGAPAESREVLQDTVNLLFNHPRQRNASRENLNLPEPQPATGQPRSRPLKVAGSPTGRLAGDQGSEEAPQRPPASSATLRRQRHLNGKVSPEKESGPRQILRSLVRLSVAAFAERNPVEELTVDSPPVQQISQLLSLLHQGQFQPKPNHRGNKYLAKPGGSRSAIPDTDGPSARAGGQTDPEQEEGPLDPEEDLSVKQLLEEELSSLLDPSTGLALDRLSAPDPAWMARLSLPLTTNYRDNVISPDAAATEEPRTFQTFGKAEAPELSPTGTRLASTFVSEMSSLLEMLLEQRSSMPVEAASEALRRLSVCGRTLSLDLATSAASGMKVQGDPGGKTGTEGKSRGSSSSSRCL

SEQ ID NO: 800155 - protein, 639 aa, Homo sapiens
SSSGTTLSHVGDALSCGEKVVQPVLSDGKASLSVLVNASTGHLLVPIETPNGLGPAGTDTPPLATHSSRPFLLTTIVARDADSGANGEPLYSIRSGNEAHLFILNPHTGQLFVNVTNASSLIGSEWELEIVVEDQGSPPLQTRALLRVMFVTSVDHLRDSARKPGALSMSMLTVICLAVLLGIFGLILALFMSICRTEKKDNRAYNCREAESTYRQQPKRPQKHIQKADIHLVPVLRGQAGEPCEVGQSHKDVDKEAMMEAGWDPCLQAPFHLTPTLYRTLRNQGNQGAPAESREVLQDTVNLLFNHPRQRNASRENLNLPEPQPATGQPRSRPLKVAGSPTGRLAGDQGSEEAPQRPPASSATLRRQRHLNGKVSPEKESGPRQILRSLVRLSVAAFAERNPVEELTVDSPPVQQISQLLSLLHQGQFQPKPNHRGNKYLAKPGGSRSAIPDTDGPSARAGGQTDPEQEEGPLDPEEDLSVKQLLEEELSSLLDPSTGLALDRLSAPDPAWMARLSLPLTTNYRDNVISPDAAATEEPRTFQTFGKAEAPELSPTGTRLASTFVSEMSSLLEMLLEQRSSMPVEAASEALRRLSVCGRTLSLDLATSAASGMKVQGDPGGKTGTEGKSRGSSSSSRCL

SEQ ID NO: 800156 - protein, 389 aa, Homo sapiens
MQLLQLLLGLLGPGGYLFLLGDCQEVTTLTVKYQVSEEVPSGTVIGKLSQELGREERRRQAGAAFQVLQLPQALPIQVDSEEGLLSTGRRLDREQLCRQWDPCLVSFDVLATGDLALIHVEIQVLDINDHQPRFPKGEQELEISESASLRTRIPLDRALDPDTGPNTLHTYTLSPSEHFALDVIVGPDETKHAELIVVKELDREIHSFFDLVLTAYDNGNPPKSGTSLVKVNVLDSNDNSPAFAESSLALEIQEDAAPGTLLIKLTATDPDQGPNGEVEFFLSKHMPPEVLDTFSIDAKTGQVILRRPLDYEKNPAYEVDVQARDLGPNPIPAHCKVLIKVLDVNDNIPSIHVTWASQPSLVSEALPKDSFIALVMADDLDSGKGGLLG

SEQ ID NO: 800157 - protein, 209 aa, Homo sapiens
MNLYGNVPTHGLVGFFCRSAIPDTDGPSARAGGQTDPEQEEGPLDPEEDLSVKQLLEEELSSLLDPSTGLALDRLSAPDPAWMARLSLPLTTNYRDNVISPDAAATEEPRTFQTFGKAEAPELSPTGTRLASTFVSEMSSLLEMLLEQRSSMPVEAASEALRRLSVCGRTLSLDLATSAASGMKVQGDPGGKTGTEGKSRGSSSSSRCL

SEQ ID NO: 800158 - protein, 387 aa, Homo sapiens
MNRHHLQDHFLEIDKKNCCVFRDDFIAKVLPPVLGLEFIFGLLGNGLALWIFCFHLKSWKSSRIFLFNLAVADFLLIICLPFVMDYYVRRSDWKFGDIPCRLVLFMFAMNRQGSIIFLTVVAVDRYFRVVHPHHALNKISNWTAAIISCLLWGITVGLTVHLLKKKLLIQNGPANVCISFSICHTFRWHEAMFLLEFLLPLGIILFCSARIIWSLRQRQMDRHAKIKRAITFIMVVAIVFVICFLPSVVVRIRIFWLLHTSGTQNCEVYRSVDLAFFITLSFTYMNSMLDPVVYYFSSPSFPNFFSTLINRCLQRKMTGEPDNNRSTSVELTGDPNKTRGAPEALMANSGEPWSPSYLGPTSNNHSKKGHCHQEPASLEKQLGCCIE

SEQ ID NO: 800159 - protein, 387 aa, Homo sapiens; identical to SEQ ID NO: 800158

SEQ ID NO: 800160 - protein, 176 aa, Homo sapiens
MEFHYVAQADLELLTSSNPPASASQSTGITGGSHRARPGPVHFIDKVTDKPSHSHPFALKENWNLNPEPSSPPSPLFLEAPSRQASQHHGASPGAGTSAGCPFEKCCSTEPCLSGLGDVGRGEAASLRARPGSGASRGQGPGSRVSCRRDLGKPLHAPAGFSAGEVHTTPLGNLGA

SEQ ID NO: 800161 - protein, 129 aa, Homo sapiens
SGSMGVLLEDVSGWGRCPNREGCPDGGGSTVVEMPTWGALRLGGVPSLVTPLSLPLIGPLPRYAQVKAFSADQVAFPGERPQHHGSYLHAPRWSARLIPAPRPGAGEPARQSRSSGWGVAVPFSTHVSF

SEQ ID NO: 800162 - protein, 176 aa, Homo sapiens; identical to SEQ ID NO: 800160

SEQ ID NO: 800163 - protein, 176 aa, Homo sapiens; identical to SEQ ID NO: 800160

SEQ ID NO: 800164 - protein, 176 aa, Homo sapiens; identical to SEQ ID NO: 800160

SEQ ID NO: 800165 - protein, 72 aa, Homo sapiens
QPEIMWAFPWEEPLYVITFYIVAVEAKWTESPRQHEVVLQVILEKLTYHTTHQPMQKPVYVQSAECLGPPKK

SEQ ID NO: 800166 - protein, 91 aa, Homo sapiens
GARGERWDLTLAAEFGAPLSGGARAALLPLADCEASCVCDAPAVSQVCPVLSLRTHQKGQARIRWEVEPRHDQKLFPYEEHLEMAMLNLTL

SEQ ID NO: 800167 - protein, 128 aa, Homo sapiens
GARGERWDLTLAAEFGAPLSGGARAALLPLAGGRRGERRGPQGSRESRGRRDGSPCRSPRHARHSLEAKLTDSSDSELLRDILQKTVKHPVCVTHPPSVKYARCFLSELIKKTCCIAQKPSCCWSGSC

SEQ ID NO: 800168 - protein, 104 aa, Homo sapiens
MGLGDRRGRRRASASAAFRTASSSSCNCSRCSSADTRSSTSIPLVPDKLSSGRRGSAGCRATQELQCPRGPSRLPGSKRGASHAPFLSRYLGLGHLDMSQGRGL

SEQ ID NO: 800169 - protein, 157 aa, Homo sapiens
RICENGPDCAGCNVEYQSCNTNPCPELKKTTPWTPWTPVNISDNGGHYEQRFRYTCKARLADPNLLEVGRQRIEMRYCSSDGTSGCSTDGLSGDFLRAGRYSAHTVNGAWSAWTSWSQCSRDCSRGIRNRKRVCNNPEPKYGGMPCLGPSLEYQECN

SEQ ID NO: 800170 - protein, 101 aa, Homo sapiens
RPPQQCRTKLRRQKRNDDSAYVIIQLIFILFQSPLESCLARAVTGSWERGSTAESQPDGGHHLISKYMHGYLDPASDRSSENMKLNAVKNYSLELLKISKT

SEQ ID NO: 800171 - protein, 135 aa, Homo sapiens
REREREGLLLDEKADCPAVTPELISTRDTTALRWRVRVFRNQTREATVSAVVRVELNRWRAGVSNGRSSEVREVLKLYKNLLYLGRDYPKGADYFKKRLKNIFLKNKDVKNPEKIKELIAQGEFVMKELEACVLP

SEQ ID NO: 800172 - protein, 1549 aa, Homo sapiens
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLALFLYWVMAFITKTIKLVKYCQSGLDISNLRFCITGMMVILNGLLMAVEINVIRVRRYVFFMNPQKVKPPEDLQDLGVRFLQPFVNLLSKATYWWMNTLIISAHKKPIDLKAIGKLPIAMRAVTNYVCLKDAYEEQKKKVADHPNRTPSIWLAMYRAFGRPILLSSTFRYLADLLGFAGPLCISGIVQRVNETQNGTNNTTGISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLSLLFTVVRFAVKAIISVQKLNEFLLSDEIGDDSWRTGESSLPFESCKKHTGVQPKTINRKQPGRYHLDSYEQSTRRLRPAETEDIAIKVTNGYFSWGSGLATLSNIDIRIPTGQLTMIVGQVGCGKSSLLLAILGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTMAHRVSSIMDAGLVLVFSEGILVECDTVPNLFAHKNGPFSTLVMTNK

SEQ ID NO: 800173 - protein, 1513 aa, Homo sapiens
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLALFLYWVMAFITKTIKLVKYCQSGLDISNLRFCITGMMVILNGLLMAVEINVIRVRRYVFFMNPQKVKPPEDLQDLGVRFLQPFVNLLSKATYWWMNTLIISAHKKPIDLKAIGKLPIAMRAVTNYVCLKDAYEEQKKKVADHPNRTPSIWLAMYRAFGRPILLSSTFRYLADLLGFAGPLCISGIVQRVNETQNGTNNTTGISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLSLLFTVVRFAVKAIISVQKLNEFLLSDEIGDDSWRTGESSLPFESCKKHTGVVTNGYFSWGSGLATLSNIDIRIPTGQLTMIVGQVGCGKSSLLLAILGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTMAHRVSSIMDAGLVLVFSEGILVECDTVPNLFAHKNGPFSTLVMTNK

SEQ ID NO: 800174 - protein, 88 aa, Homo sapiens
DGEGLRPQARRAGLLPSFLLLSRGVCPGPEQSVQFRNSIGGSSWSPTTLKIIRSGALRVSPRGGKLSSESSASGFEIYILRQCRKSVF

SEQ ID NO: 800175 - protein, 1549 aa, Homo sapiens
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLALFLYWVMAFITKTIKLVKYCQSGLDISNLRFCITGMMVILNGLLMAVEINVIRVRRYVFFMNPQKVKPPEDLQDLGVRFLQPFVNLLSKATYWWMNTLIISAHKKPIDLKAIGKLPIAMRAVTNYVCLKDAYEEQKKKVADHPNRTPSIWLAMYRAFGRPILLSSTFRYLADLLGFAGPLCISGIVQRVNETQNGTNNTTGISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLSLLFTVVRFAVKAIISVQKLNEFLLSDEIGDDSWRTGESSLPFESCKKHTGVQPKTINRKQPGRYHLDSYEQSTRRLRPAETEDIAIKVTNGYFSWGSGLATLSNIDIRIPTGQLTMIVGQVGCGKSSLLLAILGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTMAHRVHTILTADLVIVMKRGNILEYDTPESLLAQENGVFASFVRADM

SEQ ID NO: 800176 - protein, 1549 aa, Homo sapiens; identical to SEQ ID NO: 800172

SEQ ID NO: 800177 - protein, 680 aa, Homo sapiens
RESHRTRLPSPKLLGGAMGRYRIRVATGAWLFSGSYNRVQLWLVGTRGEAELELQLRPARGEEEEFDHDVAEDLGLLQFVRLRKHHWLVDDAWFCDRITVQGPGACAEVAFPCYRWVQGEDILSLPEGTARLPGDNALDMFQKHREKELKDRQQIYCWATWKEGLPLTIAADRKDDLPPNMRFHEEKRLDFEWTLKAGALEMALKRVYTLLSSWNCLEDFDQIFWGQKSALAEKVRQCWQDDELFSYQFLNGANPMLLRRSTSLPSRLVLPSGMEELQAQLEKELQNGSLFEADFILLDGIPANVIRGEKQYLAAPLVMLKMEPNGKLQPMVIQIQPPNPSSPTPTLFLPSDPPLAWLLAKSWVRNSDFQLHEIQYHLLNTHLVAEVIAVATMRCLPGLHPIFKFLIPHIRYTMEINTRARTQLISDGGIFDKAVSTGGGGHVQLLRRAAAQLTYCSLCPPDDLADRGLLGLPGALYAHDALRLWEIIARYVEGIVHLFYQRDDIVKGDPELQAWCREITEVGLCQAQDRGFPVSFQSQSQLCHFLTMCVFTCTAQHAAINQGQLDWYAWVPNAPCTMRMPPPTTKEDVTMATVMGSLPDVRQACLQMAISWHLSRRQPDMVPLGHHKEKYFSGPKPKAVLNQFRTDLEKLEKEITARNEQLDWPYEYLKPSCIENSVTI

SEQ ID NO: 800178 - protein, 133 aa, Homo sapiens
MCVFTCTAQHAAINQGQLDWYAWVPNAPCTMRMPPPTTKEDVTMATVMGSLPDVRQACLQMAISWHLSRRQPDMVPLGHHKEKYFSGPKPKAVLNQFRTDLEKLEKEITARNEQLDWPYEYLKPSCIENSVTI

SEQ ID NO: 800179 - protein, 118 aa, Homo sapiens
PKEQVVRGRERGDAVFGGPEKLRLQQERGSVLETASVGSLLLSLAWVRPAQEEEFDHDVAEDLGLLQFVRLRKHHWLVDDAWFCDRITVQGPGACAEVAFPCYRWVQGEDILSLPEGT

SEQ ID NO: 800180 - protein, 542 aa, Homo sapiens
ALAGSPAERELKDRQQIYCWATWKEGLPLTIAADRKDDLPPNMRFHEEKRLDFEWTLKAGALEMALKRVYTLLSSWNCLEDFDQIFWGQKSALAEKVRQCWQDDELFSYQFLNGANPMLLRRSTSLPSRLVLPSGMEELQAQLEKELQNGSLFEADFILLDGIPANVIRGEKQYLAAPLVMLKMEPNGKLQPMVIQIQPPNPSSPTPTLFLPSDPPLAWLLAKSWVRNSDFQLHEIQYHLLNTHLVAEVIAVATMRCLPGLHPIFKFLIPHIRYTMEINTRARTQLISDGGIFDKAVSTGGGGHVQLLRRAAAQLTYCSLCPPDDLADRGLLGLPGALYAHDALRLWEIIARYVEGIVHLFYQRDDIVKGDPELQAWCREITEVGLCQAQDRGFPVSFQSQSQLCHFLTMCVFTCTAQHAAINQGQLDWYAWVPNAPCTMRMPPPTTKEDVTMATVMGSLPDVRQACLQMAISWHLSRRQPDMVPLGHHKEKYFSGPKPKAVLNQFRTDLEKLEKEITARNEQLDWPYEYLKPSCIENSVTI

SEQ ID NO: 800181 - protein, 73 aa, Homo sapiens
IPITGRINLFSSVCPQLFVPTELCFRKLASRASFRCAAAFFKASECGPAPTVRQARCKRVRFQSIDDQWEGLS

SEQ ID NO: 800182 - protein, 104 aa, Homo sapiens
RIRPLWPGGFFSPVREVATFVEGHELRNLRLWEIEIMAGPESDAQYQFTGIKKYFNSYTLTGRMNCVLATYGSIALIVLYFKLKSKKTPAVKATIDGFKTVYGF

SEQ ID NO: 800183 - protein, 208 aa, Homo sapiens
RIRPLWPGGFFSPVREVATFVEGHELRNLRLWEIEIMAGPESDAQYQFTGIKKYFNSYTFTGRMNCVLATYGSIALIVLYFKLRSKKTPAVKATIDGFKTVYGFKLHLLSSHARKKKVIRIIFFFRPGREVVTFVEGHQLRNLRLWQIEIMAGPESDAQYQFTGIKKYFNSYTLTGRMNCVLATYGSIALIVLYFKLRSKKTPAVKAT

SEQ ID NO: 800184 - protein, 208 aa, Homo sapiens; identical to SEQ ID NO: 800183

SEQ ID NO: 800185 - protein, 70 aa, Homo sapiens
DAWVDPRVALKDTSCGICGFGSCLFPPSCALGSWPAGPPLGALQPFSKRVNVARPLQFARPAVKGLDFSL

SEQ ID NO: 800186 - protein, 70 aa, Homo sapiens; identical to SEQ ID NO: 800185

SEQ ID NO: 800187 - protein, 208 aa, Homo sapiens; identical to SEQ ID NO: 800183

SEQ ID NO: 800188 - protein, 208 aa, Homo sapiens; identical to SEQ ID NO: 800183

SEQ ID NO: 800189 - protein, 70 aa, Homo sapiens; identical to SEQ ID NO: 800185

SEQ ID NO: 800190 - protein, 70 aa, Homo sapiens; identical to SEQ ID NO: 800185

SEQ ID NO: 800191 - protein, 208 aa, Homo sapiens; identical to SEQ ID NO: 800183

SEQ ID NO: 800192 - protein, 208 aa, Homo sapiens; identical to SEQ ID NO: 800183

SEQ ID NO: 800193 - protein, 70 aa, Homo sapiens; identical to SEQ ID NO: 800185

SEQ ID NO: 800194 - protein, 70 aa, Homo sapiens; identical to SEQ ID NO: 800185

SEQ ID NO: 800195 - protein, 208 aa, Homo sapiens; identical to SEQ ID NO: 800183

SEQ ID NO: 800196 - protein, 208 aa, Homo sapiens; identical to SEQ ID NO: 800183

SEQ ID NO: 800197 - protein, 172 aa, Homo sapiens
RIRPLWPGGFFSPVREVATFVEGHELRNLRLWEIEIMAGPESDAQYQFTGIKKYFNSYTFTGRMNCVLATYGSIALIVLYFKLRSKKTPAVKATIDGFKTVYGFKLHLLSSHARKKKVIRIIFFFRPGREVVTFVEGHQLRNLRLWQIEIMAGPESDAQYQFTGIKKYKKNS

SEQ ID NO: 800198 - protein, 58 aa, Homo sapiens
MAGPESDAQYQFTGIKKYFNSYTLTGRMNCVLATYGSIALIVLYFKLRSKKTPAVKAT

SEQ ID NO: 800199 - protein, 1001 aa, Homo sapiens
MPTEKKISSASDCINSMVEGSELKKVRSNSRIYHRYFLLDADMQSLRWEPSKKDSEKAKIDIKSIKEVRTGKNTDIFRSNGISDQISEDCAFSVIYGENYESLDLVANSADVANIWVTGLRYLISYGKHTLDMLESSQDNMRTSWVSQMFSEIDVDNLGHITLCNAVQCIRNLNPGLKTSKIELKFKELHKSKDKAGTEVTKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSANTKDSVPGVSPQLLHIKIISGQNFPKPKGSGAKGDVVDPYVYVEIHGIPADCAEQRTKTVHQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKGQADLLKYAKNETLENLKQIHFAAVSCGLNKPGTENADVQKPRRSLEVIPEKANDETGE

SEQ ID NO: 800200 - protein, 1113 aa, Homo sapiens
PRAAARGGGGDAGARGRGFVQAGRGAPMAECGRGGAAGGALPTSPGPALGAKGALKAGVGEGGGGGGRLGHGRARYDSGGVSNGDCSLGVSGDEARASPTRGPRGVALAPTPSAVVCTLPRESKPGGLPRRSSIIKDGTKQKRERKKTVSFSSMPTEKKISSASDCINSMVEGSELKKVRSNSRIYHRYFLLDADMQSLRWEPSKKDSEKAKIDIKSIKEVRTGKNTDIFRSNGISDQISEDCAFSVIYGENYESLDLVANSADVANIWVTGLRYLISYGKHTLDMLESSQDNMRTSWVSQMFSEIDVDNLGHITLCNAVQCIRNLNPGLKTSKIELKFKELHKSKDKAGTEVTKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSANTKDSVPGVSPQLLHIKIISGQNFPKPKGSGAKGDVVDPYVYVEIHGIPADCAEQRTKTVHQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKIRKTGRRSIFVPQTPIMV

SEQ ID NO: 800201 - protein, 1154 aa, Homo sapiens
PRAAARGGGGDAGARGRGFVQAGRGAPMAECGRGGAAGGALPTSPGPALGAKGALKAGVGEGGGGGGRLGHGRARYDSGGVSNGDCSLGVSGDEARASPTRGPRGVALAPTPSAVVCTLPRESKPGGLPRRSSIIKDGTKQKRERKKTVSFSSMPTEKKISSASDCINSMVEGSELKKVRSNSRIYHRYFLLDADMQSLRWEPSKKDSEKAKIDIKSIKEVRTGKNTDIFRSNGISDQISEDCAFSVIYGENYESLDLVANSADVANIWVTGLRYLISYGKHTLDMLESSQDNMRTSWVSQMFSEIDVDNLGHITLCNAVQCIRNLNPGLKTSKIELKFKELHKSKDKAGTEVTKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSANTKDSVPGVSPQLLHIKIISGQNFPKPKGSGAKGDVVDPYVYVEIHGIPADCAEQRTKTVHQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKGQADLLKYAKNETLENLKQIHFAAVSCGLNKPGTENADVQKPRRSLEVIPEKANDETGE

SEQ ID NO: 800202 - protein, 226 aa, Homo sapiens
SLLRALGGSPPTATLRLACENAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKGQADLLKYAKNETLENLKQIHFAAVSCGLNKPGTENADVQKPRRSLEVIPEKANDETGE

SEQ ID NO: 800203 - protein, 126 aa, Homo sapiens
LSPPPGAAVQLRRAPQAAESAGSYATADPQRRRLPSPVATASSVQPRRFRVPAVPSPKCSGFRLGSGKCRSRLGSGSPSSALGSSVPKATHLGCSAGSPWFLLHRRVEAWGTAFCYTSPRSAKQME

SEQ ID NO: 800204 - protein, 105 aa, Homo sapiens
ALEGVLHAAEHAAKLGPGQRPRGLLRLPRGHGRSGRQNPVSEPPVASHRREPPRWSTGARCCQAPDCRACPPGDLAVSVFTSPVRHSGYPEGYRFCKGRDFKEQP

SEQ ID NO: 800205 - protein, 105 aa, Homo sapiens; identical to SEQ ID NO: 800204

SEQ ID NO: 800206 - protein, 102 aa, Homo sapiens
DGDANLRDATRSSEQRSFPLVEAQAQAPPHGEARPLAEPALSLRQPIDASPRADPVPAPDRSLSGGSAHSGRFLKPRLRRSSGETDEETTIPRPYFNYYGAV

SEQ ID NO: 800207 - protein, 102 aa, Homo sapiens; identical to SEQ ID NO: 800206

SEQ ID NO: 800208 - protein, 168 aa, Homo sapiens
SPSAAASMCEQRMCCSCVYSTSVISTRLSEPFGCTGHGLELLEEAAQSCCCPTRHLAKGPAPVCAGTSHRRLLMAGLWTHTLVRKPSSGPQATRGSSQARRQLPEPVPAAALCAGTWATASPPLALLGLGRQAHLPTCILSSSTPRSRRVHTLLQPGWAGASGLTPQP

SEQ ID NO: 800209 - protein, 87 aa, Homo sapiens
LCVPLSHTPCVSAPFCGVAAYVRADRRPVCVPPSTTASVRARLRVWQDMACAFQLCERLFLDAGCIQMLAARDLGGSLVASGRLGIC

SEQ ID NO: 800210 - protein, 228 aa, Homo sapiens
MRRISLTSSPVRLLLFLLLLLIALEIMVYNSDNNMVKPLGLLGKKVNATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTVSPVNASDIHWSSSSLPDRWIILGAFILLVLMGIVLICVWWQNGEWQAGLWPLRTS

SEQ ID NO: 800211 - protein, 186 aa, Homo sapiens
MVKPLGLLGKKVNATSTWGELTQTLGEVGRDLRMLLCDIKPQIKTSDPSTLQVEMFCQREAERCTGASWQFATNGEKSLLFDAMNMTWTVINHEASKIKETWKKDRGLEKYFRKLSKGDCDHWLREFLGHWEAMPEPTVSPVNASDIHWSSSSLPDRWIILGAFILLVLMGIVLICVWWQNGRRST

SEQ ID NO: 800212 - protein, 110 aa, Homo sapiens
MNYVDHCKEQNVPVPKEPIIFSKFASSIVGPYDEVVLPPQSQVTSIWPMRDLQVCSIPKLLAYICFLAKTFQAHHVLSVLDQGTRCSLLGSGIRDQHLDVRCTYTNSGYY

SEQ ID NO: 800213 - protein, 121 aa, Homo sapiens
MAHVAGFTVAHDVSARDWLTRCNGKQWLLGKTFDTFCPLGPALVTKDSVADPHNLKICCRVNGEVVQSSNTNQMVFKTEDLIAWVSQFVTFYPGDVILTGTPPPPPRCRCIQETSCLSQGL

SEQ ID NO: 800214 - protein, 206 aa, Homo sapiens
MNYVDHCKEQNVPVPKEPIIFSKFASSIVGPYDEVVLPPQSQEVDWEVELAVVIGKKGKHIKVLVSPMIYPPVWPNPLPPYATDAMAHVAGFTVAHDVSARDWLTRCNGKQWLLGKTFDTFCPLGPALVTKDSVADPHNLKICCRVNGEVVQSSNTNQMVFKTEDLIAWVSQFVTFYPGDVILTGTPPPPPRCRCIQETSCLSQGL

SEQ ID NO: 800215 - protein, 121 aa, Homo sapiens; identical to SEQ ID NO: 800213

SEQ ID NO: 800216 - protein, 121 aa, Homo sapiens; identical to SEQ ID NO: 800213

SEQ ID NO: 800217 - protein, 121 aa, Homo sapiens; identical to SEQ ID NO: 800213

SEQ ID NO: 800218 - protein, 338 aa, Homo sapiens
MFHCIPLWRCNRHVESIDKRHCSLVYVPEEIYRYARSLEELLLDANQLRELPEQFFQLVKLRKLGLSDNEIQRLPPEIANFMQLVELDVSRNEIPEIPESISFCKALQVADFSGNPLTRLPESFPELQNLTCLSVNDISLQSLPENIGNLYNLASLELRENLLTYLPDSLTQLRRLEELDLGNNEIYNLPESIGALLHLKDLWLDGNQLSELPQEIGNLKNLLCLDVSENRLERLPEEISGLTSLTDLVISQNLLETIPDGIGKLKKLSILKVDQNRLTQLPEAVGECESLTELVLTENQLLTLPKSIGKLKKLSNLNADRNKLVSLPKEVCAFREIT

SEQ ID NO: 800219 - protein, 524 aa, Homo sapiens
MFHCIPLWRCNRHVESIDKRHCSLVYVPEEIYRYARSLEELLLDANQLRELPEQFFQLVKLRKLGLSDNEIQRLPPEIANFMQLVELDVSRNEIPEIPESISFCKALQVADFSGNPLTRLPESFPELQNLTCLSVNDISLQSLPENIGNLYNLASLELRENLLTYLPDSLTQLRRLEELDLGNNEIYNLPESIGALLHLKDLWLDGNQLSELPQEIGNLKNLLCLDVSENRLERLPEEISGLTSLTDLVISQNLLETIPDGIGKLKKLSILKVDQNRLTQLPEAVGECESLTELVLTENQLLTLPKSIGKLKKLSNLNADRNKLVSLPKEIGGCCSLTVFCVRDNRLTRIPAEVSQATELHVLDVAGNRLLHLPLSLTALKLKALWLSDNQSQPLLTFQTDTDYTTGEKILTCVLLPQLPSEPTCQENLPRCGALENLVNDVSDEAWNERAVNRVSAIRFVEDEKDEEDNETRTLLRRATPHPGELKHMKKTVENLRNDMNAAKGLDSNKNEVNHAIDRVTTSV

SEQ ID NO: 800220 - protein, 443 aa, Homo sapiens [sequence omitted]

SEQ ID NO: 800221 - protein, 231 aa, Homo sapiens
DAWVGRVGRGRVGRPTRPKKLSNLNADRNKLVSLPKEIGGCCSLTVFCVRDNRLTRIPAEVSQATELHVLDVAGNRLLHLPLSLTALKLKALWLSDNQSQPLLTFQTDTDYTTGEKILTCVLLPQLPSEPTCQENLPRCGALENLVNDVSDEAWNERAVNRVSAIRFVEDEKDEEDNETRTLLRRATPHPGELKHMKKTVENLRNDMNAAKGLDSNKNEVNHAIDRVTTSV

SEQ ID NO: 800222 - protein, 154 aa, Homo sapiens
MFHCIPLWRCNRHVESIDKRHCSLVYVPEEIYRYARSLEELLLDANQLRELPEQFFQLVKLRKLGLSDNEIQRLPPEIANFMQLVELDVSRNEIPEIPESISFCKALQVADFSGNPLTRLPESFPELQNLTCLSVNDISLQSLPENIGKQKTTS

SEQ ID NO: 800223 - protein, 524 aa, Homo sapiens; identical to SEQ ID NO: 800219

SEQ ID NO: 800224 - protein, 524 aa, Homo sapiens; identical to SEQ ID NO: 800219

SEQ ID NO: 800225 - protein, 330 aa, Homo sapiens
PPTPDTRHPTTPAPHHTHTTHLPTARYEAVCYSAEDRLERLPEEISGLTSLTDLVISQNLLETIPDGIGKLKKLSILKVDQNRLTQLPEAVGECESLTELVLTENQLLTLPKSIGKLKKLSNLNADRNKLVSLPKEIGGCCSLTVFCVRDNRLTRIPAEVSQATELHVLDVAGNRLLHLPLSLTALKLKALWLSDNQSQPLLTFQTDTDYTTGEKILTCVLLPQLPSEPTCQENLPRCGALENLVNDVSDEAWNERAVNRVSAIRFVEDEKDEEDNETRTLLRRATPHPGELKHMKKTVENLRNDMNAAKGLDSNKNEVNHAIDRVTTSV

SEQ ID NO: 800226 - protein, 966 aa, Homo sapiens
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRSGSGSGGFLEGLFGCLRPVWNIIGKAYSTDYKLQQQDTWEVPFEEISELQWLGSGAQGAVFLGKFRAEEVAIKKVREQNETDIKHLRKLKHPNIIAFKGVCTQAPCYCIIMEYCAHGQLYEVLRAGRKITPRLLVDWSTGIASGMNYLHLHKIIHRDLKSPNVLVTHTDAVKISDFGTSKELSDKSTKMSFAGTVAWMAPEVIRNEPVSEKVDIWSFGVVLWELLTGEIPYKDVDSSAIIWGVGSNSLHLPVPSTCPDGFKILMKQTWQSKPRNRPSFRQTLMHLDIASADVLATPQETYFKSQAEWREEVKKHFEKIKSEGTCIHRLDEELIRRRREELRHALDIREHYERKLERANNLYMELSAIMLQLEMREKELIKREQAVEKKYPGTYKRHPVRPIIHPNAMEKLMKRKGVPHKSGMQTKRPDLLRSEGIPTTEVAPTASPLSGSPKMSTSSSKSRYRSKPRHRRGNSRGSHSDFAAILKNQPAQENSPHPTYLHQAQSQYPSLHHHNSLQQQYQQPPPAMSQSHHPRLNMHGQDIATCANNLRYFGPAAALRSPLSNHAQRQLPGSSPDLISTAMAADCWRSSEPDKGQAGPWGCCQADAYDPCLQCRPEQYGSLDIPSAEPVGRSPDLSKSPAHNPLLENAQSSEKTEENEFSGCRSESSLGTSHLGTPPALPRKTRPLQKSGDDSSEEEEGEVDSEVEFPRRQRPHRCISSCQSYSTFSSENFSVSDGEEGNTSDHSNSPDELADKLEDRLAEKLDDLLSQTPEIPIDISSHSDGLSDKECAVRRVKTQMSLGKLCVEERGYENPMQFEESDCDSSDGECSDATVRTNKHYSSATW

SEQ ID NO: 800227 - protein, 128 aa, Homo sapiens
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRYLGSAI

SEQ ID NO: 800228 - protein, 571 aa, Homo sapiens
PSVPLCGHFKDVAIDVVKCVASPLETYFKSQAEWREEVKKHFEKIKSEGTCIHRLDEELIRRRREELRHALDIREHYERKLERANNLYMELSAIMLQLEMREKELIKREQAVEKKYPGTYKRHPVRPIIHPNAMEKLMKRKGVPHKSGMQTKRPDLLRSEGIPTTEVAPTASPLSGSPKMSTSSSKSRYRSKPRHRRGNSRGSHSDFAAILKNQPAQENSPHPTYLHQAQSQYPSLHHHNSLQQQYQQPPPAMSQSHHPRLNMHGQDIATCANNLRYFGPAAALRSPLSNHAQRQLPGSSPDLISTAMAADCWRSSEPDKGQAGPWGCCQADAYDPCLQCRPEQYGSLDIPSAEPVGRSPDLSKSPAHNPLLENAQSSEKTEENEFSGCRSESSLGTSHLGTPPALPRKTRPLQKSGDDSSEEEEGEVDSEVEFPRRQRPHRCISSCQSYSTFSSENFSVSDGEEGNTSDHSNSPDELADKLEDRLAEKLDDLLSQTPEIPIDISSHSDGLSDKECAVRRVKTQMSLGKLCVEERGYENPMQFEESDCDSSDGECSDATVRTNKHYSSATW

SEQ ID NO: 800229 - protein, 551 aa, Homo sapiens
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRSGSGSGGFLEGLFGCLRPVWNIIGKAYSTDYKLQQQDTWEVPFEEISELQWLGSGAQGAVFLGKFRAEEVAIKKVREQNETDIKHLRKLKHPNIIAFNVLVTHTDAVKISDFGTSKELSDKSTKMSFAGTVAWMAPEVIRNEPVSEKVDIWSFGVVLWELLTGEIPYKDVDSSAIIWGVGSNSLHLPVPSTCPDGFKILMKQTWQSKPRNRPSFRQTLMHLDIASADVLATPQETYFKSQAEWREEVKKHFEKIKSEGTCIHRLDEELIRRRREELRHALDIREHYERKLERANNLYMELSAIMLQLEMREKELIKREQAGGKNVSGDPKRNTGTHNNHIQSAGRHSWTREQGGCAPTTLGEGGPQRGQNGEHRKGLHKIKRVHQGYPVTGDKKEPHQQTEIKTRTTKEGTIRPRETRPQNTEENRKAT

SEQ ID NO: 800230 - protein, 55 aa, Homo sapiens
METWGDWRPRLGDPTVIRVFRQTLGAAPSEADEKKQKGEVSKSQLRAPAPGTPWG

SEQ ID NO: 800231 - protein, 393 aa, Homo sapiens
MAPPPPSPQLLLLAALARLLGPSEVMAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSALRFPSASPGSLKAKQSMAGIPGRESNAPSVPTVSLLPGAPGGNASSRTEAQVPNGQGSPGGCVCSSQASPAPRAAAPPRAARGPTPRTEEAAWAAMALTFLLVLLTLATLCTRLHRNFRRGESIYWGPTADSQDTVAAVLKRRLLQPSRRVKRSRRRPLLPPTPDSGPEGESSE

SEQ ID NO: 800232 - protein, 368 aa, Homo sapiens
MAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSALRFPSASPGSLKAKQSMAGIPGRESNAPSVPTVSLLPGAPGGNASSRTEAQVPNGQGSPGGCVCSSQASPAPRAAAPPRAARGPTPRTEEAAWAAMALTFLLVLLTLATLCTRLHRNFRRGESIYWGPTADSQDTVAAVLKRRLLQPSRRVKRSRRRPLLPPTPDSGPEGESSE

SEQ ID NO: 800233 - protein, 277 aa, Homo sapiens
MAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSALRFPSASPGSLKAKQSMAGIPGRESNAPSVPTVSLLPGAPGGNASSRTEAQVPNGQGSPGGCVCSSQASPAPRAAAPPRAARGPTPRTEEAAWAAMALTFLLVLLTLATLCTRLHRNFRRGESIYWGPTADSQDTVAAVLKRRLLQPSRRVKRSRRRPLLPPTPDSGPEGESSE

SEQ ID NO: 800234 - protein, 368 aa, Homo sapiens; identical to SEQ ID NO: 800232

SEQ ID NO: 800235 - protein, 368 aa, Homo sapiens; identical to SEQ ID NO: 800232

SEQ ID NO: 800236 - protein, 368 aa, Homo sapiens; identical to SEQ ID NO: 800232

SEQ ID NO: 800237 - protein, 368 aa, Homo sapiens; identical to SEQ ID NO: 800232

SEQ ID NO: 800238 - protein, 393 aa, Homo sapiens; identical to SEQ ID NO: 800231

SEQ ID NO: 800239 - protein, 97 aa, Homo sapiens
GRRGRRGGAGAGGAGRARSLAGGAAGRRAGPGAAWNGASSAFAPTASPGSPREAPGSQRGDGWTGGGGGSPLSREPVASASAGVTKSDLHTSEPRAG

SEQ ID NO: 800240 - protein, 204 aa, Homo sapiens
MAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSAWDGHRGGRGR

SEQ ID NO: 800241 - protein, 368 aa, Homo sapiens; identical to SEQ ID NO: 800232

SEQ ID NO: 800242 - protein, 393 aa, Homo sapiens; identical to SEQ ID NO: 800231

SEQ ID NO: 800243 - protein, 537 aa, Homo sapiens
METWGDWRPRLGDPTVIRVFRQTLGAAPSEADEKKQKGELWDRHLDPRSLPTFPPQILEREPEPAPRCGAGRPAHLLGVTPTNLKRVCQGSVPVSPAWATRSTGIPFPALHSAPRSHPGAAAVQLLYRLQGPAETNPRTRKGAPRLPSEPCALTRFLHLTFPASGLRRVMAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSALRFPSASPGSLKAKQSMAGIPGRESNAPSVPTVSLLPGAPGGNASSRTEAQVPNGQGSPGGCVCSSQASPAPRAAAPPRAARGPTPRTEEAAWAAMALTFLLVLLTLATLCTRLHRNFRRGESIYWGPTADSQDTVAAVLKRRLLQPSRRVKRSRRRPLLPPTPDSGPEGESSE

SEQ ID NO: 800244 - protein, 386 aa, Homo sapiens
MAPPPPSPQLLLLAALARLLGPSEVMAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSALRFPSASPGSLKAKQSMAGIPGRESNAPSVPTVSLLPGAPGGNASSRTEAQVPNGQGSPGGCVCSSQASPAPRAAAPPRAARGPTPRTEEAAWAAMALTFLLVLLTLATLCTRLHRNFRRGESIYWGPTADSQDTVAGEEFPPYPTRGPRPTSRRPPPPVASLPSRP

SEQ ID NO: 800245 - protein, 393 aa, Homo sapiens; identical to SEQ ID NO: 800231

SEQ ID NO: 800246 - protein, 378 aa, Homo sapiens
MAPPPPSPQLLLLAALARLLGPSEVMAGPAEEAGAHCPESLWPLPPQVSPRVTYTRVSPGQAEDVTFLYHPCAHPWLKLQLALLAYACMANPSLTPDFSLTQDRPLVLTAWGLALEMAWVEPAWAAHWLMRRRRRKQRKKKAWIYCESLSGPAPSEPTPGRGRLCRRGCVQALALAFALRSWRPPGTEVTSQGPRQPSSSGAKRRRLRAALGPQPTRSALRFPSASPGSLKAKQSMAGIPGRESNAPSVPTVSLLPGAPGGNASSRTEAQVPNGQGSPGGCVCSSQASPAPRAAAPPRAARGPTPRTEEAAWAAMALTFLLVLLTLATLCTRLHRNFRRGESIYWPRPLPRGPRAGRSLVAMARHWPSTAGAFLLVGC

SEQ ID NO: 800247 - protein, 426 aa, Homo sapiens
MAVETRAELVGKRFLCVAVGDEARSERWESGRGWRSWRAGVIRAVSHRDSRNPDLAVYVEFDDLEWDKREWVKVYEDFSTFLVEYHLIWAKRNDPSQTQGSKSKQIQWPALTFKPLVERNIPSSVTAVEFLVDKQLDFLTEDSAFQPYQDDIDSLNPVLRDNPQLHEEVKVWVKEQKVQEIFMQGPYSLNGYRVRVYRQDSATQWFTGIITHHDLFTRTMIVMNDQVLEPQNVDPSMVQMTFLDDVVHSLLKGENIGITSRRRSRANQNVNAVHSHYTRAQANSPRPAMNSQAAVPKQNTHQQQQQRSIRPNKRKGSDSSIPDEEKMKEEKYDYISRGENPKGKNKHLMNKRRKPEEDEKKLNMKRLRTDNVSDFSESSDSENSNKRIIDNSSEQKPENELKNKNTSKINGEEGKPHNNEKAGEET

SEQ ID NO: 800248 - protein, 426 aa, Homo sapiens; identical to SEQ ID NO: 800247

SEQ ID NO: 800249 - protein, 426 aa, Homo sapiens; identical to SEQ ID NO: 800247

SEQ ID NO: 800250 - protein, 141 aa, Homo sapiens [sequence omitted]

SEQ ID NO: 800251 - protein, 409 aa, Homo sapiens
AAPHRTQPSSATAAAAVAAAVAAARPSAVAGSSAATWTKVYVEFDDLEWDKREWVKVYEDFSTFLVEYHLIWAKRNDPSQTQGSKSKQIQWPALTFKPLVERNIPSSVTAVEFLVDKQLDFLTEDSAFQPYQDDIDSLNPVLRDNPQLHEEVKVWVKEQKVQEIFMQGPYSLNGYRVRVYRQDSATQWFTGIITHHDLFTRTMIVMNDQVLEPQNVDPSMVQMTFLDDVVHSLLKGENIGITSRRRSRANQNVNAVHSHYTRAQANSPRPAMNSQAAVPKQNTHQQQQQRSIRPNKRKGSDSSIPDEEKMKEEKYDYISRGENPKGKNKHLMNKRRKPEEDEKKLNMKRLRTDNVSDFSESSDSENSNKRIIDNSSEQKPENELKNKNTSKINGEEGKPHNNEKAGEET

SEQ ID NO: 800252 - protein, 426 aa, Homo sapiens; identical to SEQ ID NO: 800247

SEQ ID NO: 800253 - protein, 130 aa, Homo sapiens [sequence omitted]

SEQ ID NO: 800254 - protein, 130 aa, Homo sapiens [sequence omitted]

SEQ ID NO: 800255 - protein, 347 aa, Homo sapiens
RHEGVWCGHSKAKAASLACRDAKEAGLVRPLQGQSEKILLRTRNRQPMEPPMEPSGGEQEPGAVRFLDLPWEDVLLPHVLNRVPLRQLLRLQRVSRAFRSLVQLHLAGLRRFDAAQVGPQIPRAALARLLRDAEGLQELALAPCHEWLSDEDLVPVLARNPQLRSVALGGCGQLSRRALGALAEGCPRLQRLSLAHCDWVDGLALRGLADRCPALEELDLTACRQLKDEAIVYLAQRRGAGLRSLSLAVNANVGDAAVQELARNCPELHHLDLTGCLRVGSDGVRTLAEYCPVLRSLRVRHCHHVAESSLSRLRKRGVDIDVEPPLHQALVLLQDMAGFAPFVNLQV

SEQ ID NO: 800256 - protein, 70 aa, Homo sapiens
RPRQAHGMGVDWTRPLNPGDHQLWKGDLGNTVLNPPGVLSLGPRRSNPDHPPRMQQGDVKSDFRKNFLAA

SEQ ID NO: 800257 - protein, 300 aa, Homo sapiens
MEPPMEPSGGEQEPGAVRFLDLPWEDVLLPHVLNRVPLRQLLRLQRVSRAFRSLVQLHLAGLRRFDAAQVGPQIPRAALARLLRDAEGLQELALAPCHEWLSDEDLVPVLARNPQLRSVALGGCGQLSRRALGALAEGCPRLQRLSLAHCDWVDGLALRGLADRCPALEELDLTACRQLKDEAIVYLAQRRGAGLRSLSLAVNANVGDAAVQELARNCPELHHLDLTGCLRVGSDGVRTLAEYCPVLRSLRVRHCHHVAESSLSRLRKRGVDIDVEPPLHQALVLLQDMAGFAPFVNLQV

SEQ ID NO: 800258 - protein, 300 aa, Homo sapiens; identical to SEQ ID NO: 800257

SEQ ID NO: 800259 - protein, 300 aa, Homo sapiens; identical to SEQ ID NO: 800257

SEQ ID NO: 800260 - protein, 387 aa, Homo sapiens
MRSGFRCDEPAEAVAPERQTVSGAVALASFTSPHTHPVDDGGRHYSWGSPKRILGLGPGDAAKEAGLVRPLQGQSEKILLRTRNRQPMEPPMEPSGGEQEPGAVRFLDLPWEDVLLPHVLNRVPLRQLLRLQRVSRAFRSLVQLHLAGLRRFDAAQVGPQIPRAALARLLRDAEGLQELALAPCHEWLSDEDLVPVLARNPQLRSVALGGCGQLSRRALGALAEGCPRLQRLSLAHCDWVDGLALRGLADRCPALEELDLTACRQLKDEAIVYLAQRRGAGLRSLSLAVNANVGDAAVQELARNCPELHHLDLTGCLRVGSDGVRTLAEYCPVLRSLRVRHCHHVAESSLSRLRKRGVDIDVEPPLHQALVLLQDMAGFAPFVNLQV

SEQ ID NO: 800261 - protein, 266 aa, Homo sapiens
MEPPMEPSGGEQEPGAVRFLDLPWEDVLLPHVLNRVPLRQLLRLQRVSRAFRSLVQLHLAGLRRFDAAQVGPQIPRAALARLLRDAEGLQELALAPCHEWLSDEDLVPVLARNPQLRSVALGGCGQLSRRALGALAEGCPRLQRLSLAHCDWVDGLALRGLADRCPALEELDLTACRQLKDEAIVYLAQRRGAGLRSLSLAVNANVGDAAVQELARNCPELHHLDLTGCLRVGSDGVRCLGLIGREEGSHLASAGMGRAVVVKRPD

SEQ ID NO: 800262 - protein, 179 aa, Homo sapiens
PRGKRNLREGSRAGAGSGGRSWELGRRNITEADSQVIVAPGRQCQRPFTRRFLDLPWEDVLLPHVLNRVPLRQLLRLQRVSRAFRSLVQLHLAGLRRFDAAQVSRGLKPRPCLGTAPPLAQPPAPQYALLDPLGPPGLPGRDPRTKGQILGSDSEGKWGLSWESRRLPEKNSGQGCIGG

SEQ ID NO: 800263 - protein, 300 aa, Homo sapiens; identical to SEQ ID NO: 800257

SEQ ID NO: 800264 - protein, 300 aa, Homo sapiens; identical to SEQ ID NO: 800257

SEQ ID NO: 800265 - protein, 300 aa, Homo sapiens; identical to SEQ ID NO: 800257

SEQ ID NO: 800266 - protein, 333 aa, Homo sapiens
PRGKRNLREGSRAGAGSGGRSWELGRRNITEADSQVIVAPGRQCQRPFTRRFLDLPWEDVLLPHVLNRVPLRQLLRLQRVSRAFRSLVQLHLAGLRRFDAAQVGPQIPRAALARLLRDAEGLQELALAPCHEWLSDEDLVPVLARNPQLRSVALGGCGQLSRRALGALAEGCPRLQRLSLAHCDWVDGLALRGLADRCPALEELDLTACRQLKDEAIVYLAQRRGAGLRSLSLAVNANVGDAAVQELARNCPELHHLDLTGCLRVGSDGVRTLAEYCPVLRSLRVRHCHHVAESSLSRLRKRGVDIDVEPPLHQALVLLQDMAGFAPFVNLQV

SEQ ID NO: 800267 - protein, 266 aa, Homo sapiens; identical to SEQ ID NO: 800261

SEQ ID NO: 800268 - protein, 203 aa, Homo sapiens
FGHRRRLPGLSMSPRRTLPRPLSLCLSLCLCLCLAAALGSAQSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQCGAHLGHIFDDGPRPTGKRYCINSAALSFTPADSSGTAEGGSGVASPAQADKAEL

SEQ ID NO: 800269 - protein, 174 aa, Homo sapiens
FGHRRRLPGLSMSPRRTLPRPLSLCLSLCLCLCLAAALGSAQSGSCRDKKNCKVVFSQQELRKRLTPLQYHVTQEKGTESAFEGEYTHHKDPGIYKCVVCGTPLFKFLCLLVPGWPSFHDVINSEAITFTDDFSYGMHRVETSCSQQEGPHQMLPLNLGFPGLQNCEPINFYSF

SEQ ID NO: 800270 - protein, 361 aa, Homo sapiens
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGGELTSPALGLASHQVPPSPLVSANGPGEEKLFRSQSADAPGPTERERLKKMLSEGSVGEVQWEAEFFALQDSNNKLAGALREANAAAAQWRQQLEAQRAEAERLRQRVAELEAQAASEVTPTGEKEGLGQGQSLEQLEALVQTKDQEIQTLKSQTGGPREALEAAEREETQQKVQDLETRNAELEHQLRAMERSLEEARAERERARAEVGRAAQLLDVRLFELSELREGLARLAEAAP

SEQ ID NO: 800271 - protein, 361 aa, Homo sapiens; identical to SEQ ID NO: 800270

SEQ ID NO: 800272 - protein, 361 aa, Homo sapiens; identical to SEQ ID NO: 800270

SEQ ID NO: 800273 - protein, 294 aa, Homo sapiens [sequence omitted]

SEQ ID NO: 800274 - protein, 128 aa, Homo sapiens
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKCSFRGDPHR

SEQ ID NO: 800275 - protein, 397 aa, Homo sapiens
DEEKKREKKNKAKGEKEKRETRQEEKRRQRRNKQGDILYRIECLVLCVGYEGVEGGAEGAGPGARERAGRPAARSQRRGGRTRLAPGHSRGADLAGRPDPARGGQNQVALCNLSGVGPLKRLGQSKLDQWFPQAQGGSPNFLSQHRAHFCSQILTPKATRRQRGSAERRYKTGLVGSVRGPPGGATAQQGGDAPEGFFRHWAEEPANPNKGCGRAPCGREGQGRREAPSGAATAGLGGRFQRVKERPERFCGARGWLTLGRASAASFKRVEPPTGVNKGRALGARAPVRGNPAWEALGVQPQGPREIQTLKSQTGGPREALEAAEREETQQKVQDLETRNAELEHQLRAMERSLEEARAERERARAEVGRAAQLLDVRLFELSELREGLARLAEAAP

SEQ ID NO: 800276 - protein, 250 aa, Homo sapiens
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKSQDGGELTSPALGLASHQVPPSPLVSANGPGEEKLFRSQSADAPGPTERERWFSMNDSGLGCGPGCRRHSWAHSSWKGTGGSQLSPGWAGPGWAGVGPSRLWLLAALGLFLSFSLCRISRSPDYISKREKK

SEQ ID NO: 800277 - protein, 361 aa, Homo sapiens; identical to SEQ ID NO: 800270

SEQ ID NO: 800278 - protein, 361 aa, Homo sapiens; identical to SEQ ID NO: 800270

SEQ ID NO: 800279 - protein, 325 aa, Homo sapiens [sequence omitted]

SEQ ID NO: 800280 - protein, 142 aa, Homo sapiens
MSTAREQPIFSTRAHVFQIDPATKRNWIPAGKHALTVSYFYDATRNVYRIISIGGAKAIINSTVTPNMTFTKTSQKFGQWADSRANTVYGLGFASEQHLTQFAEKFQEVKEAARLAREKCWGGPQSALVVGSFGAVFELLIV

SEQ ID NO: 800281 - protein, 115 aa, Homo sapiens
RPLWGVHFIPGVLGALGWLWAEEGHEGGQTLDASGRTGDLLGPPTLPTLSWQDLETRNAELEHQLRAMERSLEEARAERERARAEVGRAAQLLDVRLFELSELREGLARLAEAAP

SEQ ID NO: 800282 - protein, 101 aa, Homo sapiens
PYLFEQVAKDLAKKEAEQWYLDTLKQAGLEEDFVRNKGQGTRAVQEKETKIKDFPRFQETTKLSIRDPEQGLEGSLEQPASPRKVLEELSHQSPENLVSLA

SEQ ID NO: 800283 - protein, 97 aa, Homo sapiens
PYLFEQVAKDLAKKEAEQWYLDTLKQAGLEEDFVRNKGQGTRAVQEKETKIKDFPRFQETTKLSIRDPEQGLEGSLEQPASPRCVFFGGDRVTITWA

SEQ ID NO: 800284 - protein, 101 aa, Homo sapiens; identical to SEQ ID NO: 800282

SEQ ID NO: 800285 - protein, 919 aa, Homo sapiens
LVPTLFNLLSRCLEPLPQEQGNMEYTKQLILSCLLNICQKLSPDGGKIPKDILDEEKFNVELIVQCIRLSEMPQTHHHALLLLGTVAGIFPDKVLHNIMSIFTFMGANVMRLDDTYSFQVINKTVKMVIPALIQSDSGDSIEVSRNVEEIVVKIISVFVDALPHVPEHRRLPILVQLVDTLGAEKFLWILLILLFEQYVTKTVLAAAYGEKDAILEADTEFWFSVCCEFSVQHQIQSLMNILQYLLKLPEEKEETIPKAVSFNKSESQEEMLQVFNVETHTSKQLRHFKFLSVSFMSQLLSSNNFLKKVVESGGPEILKGLEERLLETVLGYISAVAQSMERNADKLTVKFWRALLSKAYDLLDKVNALLPTETFIPVIRGLVGNPLPSVRRKALDLLNNKLQQNISWKKTIVTRFLKLVPDLLAIVQRKKKEGEEEQAINRQTALYTLKLLCKNFGAENPDPFVPVLSTAVKLIAPERKEEKNVLGSALLCIAEVTSTLEALAIPQLPSLMPSLLTTMKNTSELVSSEVYLLSALAALQKVVETLPHFISPYLEGILSQVIHLEKITSEMGSASQANIRLTSLKKTLATTLAPRVLLPAIKKTYKQIEKNWKNHMGPFMSILQEHIGVMKKEELTSHQSQLTAFFLEALDFRAQHSENDLEEVGKTENCIIDCLVAMVVKLSEVTFRPLFFKLFDWAKTEDAPKDRLLTFYNLADCIAEKLKGLFTLFAGHLVKPFADTLDQVNISKTDEAFFDSENDPEKCCLLLQFILNCLYKIFLFDTQHFISKERAGALMMPLVDQLENRLGGEEKFQERVTKHLIPCIAQFSVAMADDSLWKPLNYQILLKTRDSSPKVRFAALITVLALAEKLKENYIVLLPESIPFLAELMEDECEEVEHQCQKTIQQLETVLGEPLQSYF

SEQ ID NO: 800286 - protein, 899 aa, Homo sapiens
LVPTLFNLLSRCLEPLPQEQGNMEYTKQLILSCLLNICQKLSPDGGKIPKDILDEEKFNVELIVQCIRLSEMPQTHHHALLLLGTVAGIFPDKVLHNIMSIFTFMGANVMRLDDTYSFQVINKTVKMVIPALIQSDSGDSIEVSRNVEEIVVKIISVFVDALPHVPEHRRLPILVQLVDTLGAEKFLWILLILLFEQYVTKTVLAAAYGEKDAILEADTEFWFSVCCEFSVQHQIQSLMNILQYLLKLPEEKEETIPKAVSFNKSESQEEMLQVFNVETHTSKQLRHFKFLSVSFMSQLLSSNNFLKKVVESGGPEILKGLEERLLETVLGYISAVAQSMERNADKLTVKFWRALLSKAYDLLDKVNALLPTETFIPVIRGLVGNPLPSVRRKALDLLNNKLQQNISWKKTIVTRFLKLVPDLLAIVQRKKKEGEEEQAINRQTALYTLKLLCKNFGAENPDPFVPVLSTAVKLIAPERKEEKNVLGSALLCIAEVTSTLEALAIPQLPSLMPSLLTTMKNTSELVSSEVYLLSALAALQKVVETLPHFISPYLEGILSQVIHLEKITSEMGSASQANIRLTSLKKTLATTLAPRVLLPAIKKTYKQIEKNWKNHMGPFMSILQEHIGVMKKEELTSHQSQLTAFFLEALDFRAQHSENDLEEVGKTENCIIDCLVAMVVKLSEVTFRPLFFKLFDWAKTEDAPKDRLLTFYNLADCIAEKLKGLFTLFAGHLVKPFADTLDQVNISKTDEAFFDSENDPEKCCLLLQFILNCLYKIFLFDTQHFISKERAGALMMPLVDQLENRLGGEEKFQERVTKHLIPCIAQFSVAMADDSLWKPLNYQILLKTRDSSPKVRFAALITVLALAEKLKENYIVLLPESIPFLAELMEGNSQTIPNH

SEQ ID NO: 800287 - protein, 424 aa, Homo sapiens
LVPTLFNLLSRCLEPLPQEQGNMEYTKQLILSCLLNICQKLSPDGGKIPKDILDEEKFNVELIVQCIRLSEMPQTHHHALLLLGTVAGIFPDKVLHNIMSIFTFMGANVMRLDDTYSFQVINKTVKMVIPALIQSDSGDSIEVSRNVEEIVVKIISVFVDALPHVPEHRRLPILVQLVDTLGAEKFLWILLILLFEQYVTKTVLAAAYGEKDAILEADTEFWFSVCCEFSVQHQIQSLMNILQYLLKLPEEKEETIPKAVSFNKSESQEEMLQVFNVETHTSKQLRHFKFLSVSFMSQLLSSNNFLKKVVESGGPEILKGLEERLLETVLGYISAVAQSMERNADKLTVKFWRALLSKAYDLLDKVNALLPTETFIPVIRGLVGNPLPSVRRKALDLLNNKLQQNISWKKTIVTRFLKLVPDYF

SEQ ID NO: 800288 - protein, 76 aa, Homo sapiens
QKPEVLSVFKPPGIPAFSLWGRKPGPLGVTLLTESQELSRYLNKAFHIGPRKKNSHPLLKPNVISHTGLALTFYSV

SEQ ID NO: 800289 - protein, 447 aa, Homo sapiens
FFQHFIECIFHFNNYEKHEKYNKFPQSEREKRLFSLKGKSNKERRMKIYKFLLEHFTDEQRFNITSKICLSILACFADGILPLDLDASELLSDTFEVLSSKEIKLLAMRSKPDKDLLMEEDDMALANVVMQEAQKKLISQVQKRNFIENIIPIIISLKTVLEKNKIPALRELMHYLREVMQDYRDELKDFFAVDKQLASELEYDMKKYQEQLVQEQELAKHADVAGTAGGAEVAPVAQVALCLETVPVPAGQENPAMSPAVSQPCTPRASAGHVAVSSPTPETGPLQRLLPKARPMSLSTIAILNSVKKAVESKSRHRSRSLGVLPFTLNSGSPEKTCSQVSSYSLEQESNGEIEHVTKRAISTPEKSISDVTFGAGVSYIGTPRTPSSAKEKIEGRSQGNDILCLSLPDKPPPQPQQWNVRSPARNKDTPACSRRSLRKTPLKTAN

SEQ ID NO: 800290 - protein, 392 aa, Homo sapiens
FFQHFIECIFHFNNYEKHEKYNKFPQSEREKRLFSLKGKSNKERRMKIYKFLLEHFTDEQRFNITSKICLSILACFADGILPLDLDASELLSDTFEVLSSKEIKLLAMRSKPDKDLLMEEDDMALANVVMQEAQKKLISQVQKRNFIENIIPIIISLKTVLEKNKIPALRELMHYLREVMQDYRDELKDFFAVDKQLASELEYDMKKYQEQLVQEQELAKHADVAGTAGGAEVAPVAQVALCLETVPVPAGQENPAMSPAVSQPCTPRASAGHVAVSSPTPETGPLQRLLPKARPMSLSTIAILNSVKKAVESKSRHRSRSLGVLPFTLNSGSPEKTCSQVSSYSLEQESNGEIEHVTKRAISTPEMSLHSVSQTPQWPAEQTMPLRHREHQ

SEQ ID NO: 800291 - protein, 325 aa, Homo sapiens
ELQIEHIPEEAQKKLISQVQKRNFIENIIPIIISLKTVLEKNKIPALRELMHYLREVMQDYRDELKDFFAVDKQLASELEYDMKKYQEQLVQEQELAKHADVAGTAGGAEVAPVAQVALCLETVPVPAGQENPAMSPAVSQPCTPRASAGHVAVSSPTPETGPLQRLLPKARPMSLSTIAILNSVKKAVESKSRHRSRSLGVLPFTLNSGSPEKTCSQVSSYSLEQESNGEIEHVTKRAISTPEKSISDVTFGAGVSYIGTPRTPSSAKEKIEGRSQGNDILCLSLPDKPPPQPQQWNVRSPARNKDTPACSRRSLRKTPLKTAN

SEQ ID NO: 800292 - protein, 368 aa, Homo sapiens
FFQHFIECIFHFNNYEKHEKYNKFPQSEREKRLFSLKGKSNKERRMKIYKFLLEHFTDEQRFNITSKICLSILACFADGILPLDLDASELLSDTFEVLSSKEIKLLAMRSKPDKDLLMEEDDMALANVVMQEAQKKLISQVQKRNFIENIIPIIISLKTVLEKNKIPALRELMHYLREVMQDYRDELKDFFAVDKQLASELEYDMKKYQEQLVQEQELAKHADVAGTAGGAEVAPVAQVALCLETVPVPAGQENPAMSPAVSQPCTPRASAGHVAVSSPTPETGPLQRLLPKARPMSLSTIAILNSVKKAVESKSRHRSRSLGVLPFTLNSGSPEKTCSQVSSYSLEQESNGEIEHVTKRAISTPESE

SEQ ID NO: 800293 - protein, 403 aa, Homo sapiens
MAPQLWELHLLSGPEHFSEAHVFLSLCLSACFADGILPLDLDASELLSDTFEVLSSKEIKLLAMRSKPDKDLLMEEDDMALANVVMQEAQKKLISQVQKRNFIENIIPIIISLKTVLEKNKIPALRELMHYLREVMQDYRDELKDFFAVDKQLASELEYDMKKYQEQLVQEQELAKHADVAGTAGGAEVAPVAQVALCLETVPVPAGQENPAMSPAVSQPCTPRASAGHVAVSSPTPETGPLQRLLPKARPMSLSTIAILNSVKKAVESKSRHRSRSLGVLPFTLNSGSPEKTCSQVSSYSLEQESNGEIEHVTKRAISTPEKSISDVTFGAGVSYIGTPRTPSSAKEKIEGRSQGNDILCLSLPDKPPPQPQQWNVRSPARNKDTPACSRRSLRKTPLKTAN

SEQ ID NO: 800294 - protein, 415 aa, Homo sapiens
FFQHFIECIFHFNNYEKHEKYNKFPQSEREKRLFSLKGKSNKERRMKIYKFLLEHFTDEQRFNITSKICLSILACFADGILPLDLDASELLSDTFEVLSSKEIKLLAMRSKPDKDLLMEEDDMALANVVMQEAQKKLISQVQKRNFIENIIPIIISLKTVLEKNKIPALRELMHYLREVMQDYRDELKDFFAVDKQLASELEYDMKKYQEQLVQEQELAKHADVAGTAGGAEVAPVAQVALCLETVPVPAGQENPAMSPAVSQPCTPRASAGHVAVSSPTPETGPLQRLLPKARPMSLSTIAILNSVKKAVESKSRHRSRSLGVLPFTLNSGSPEKTCSQVSSYSLEQESNGEIEHVTKRAISTPEKSISDVTFGAGVSYIGTPRTPSSAKGAQSWDATWKTPVSLQCPPESCAG

SEQ ID NO: 800295 - protein, 313 aa, Homo sapiens
TVTATIKIPKWSGNTYGQLCRETVCFSVEPVKKIFNYMIHVNRNIMDFKLFLVFVAGVFLFFYARTLSQSPTFYYSSGTVLGVLMTLVFVLLLVKRFIPKYSTFWALMVGCWFASVYIVCQLMEDLKWLWYENRIYVLGYVLIVGFFSFVVCYKHGPLADDRSRSLLMWMLRLLSLVLVYAGVAVPQFAYAAIILLMSSWSLHYPLRACSYMRWKMEQWFTSKELVVKYLTEDEYREQADAETNSALEELRRACRKPDFPSWLVVSRLHTPSKFADFVLGGSHLSPEEISLHEEQYGLGGAFLEEQLFNPSTA

SEQ ID NO: 800296 - protein, 276 aa, Homo sapiens
MIHVNRNIMDFKLFLVFVAGVFLFFYARTLSQSPTFYYSSGTVLGVLMTLVFVLLLVKRFIPKYSTFWALMVGCWFASVYIVCQLMEDLKWLWYENRIYVLGYVLIVGFFSFVVCYKHGPLADDRSRSLLMWMLRLLSLVLVYAGVAVPQFAYAAIILLMSSWSLHYPLRACSYMRWKMEQWFTSKELVVKYLTEDEYREQADAETNSALEELRRACRKPDFPSWLVVSRLHTPSKFADFVLGGSHLSPEEISLHEEQYGLGGAFLEEQLFNPSTA

SEQ ID NO: 800297 - protein, 236 aa, Homo sapiens
MIHVNRNIMDFKLFLVFVAGVFLFFYARTLSQSPTFYYSSGTVLGVLMTLVFVLLLVKRFIPKYSTFWALMVGCWFASVYIVCQLMEDLKWLWYENRIYVLGYVLIVGFFSFVVCYKHGPLADDRSRSLLMWMLRLLSLVLVYAGVAVPQFAYAAIILLMSSWSLHYPLRACSYMRWKMEQWFTSKELVVKYLTEDEYREQADAETNSALEELRRACRKPDFPSWLVVSRLHTPSN

SEQ ID NO: 800298 - protein, 252 aa, Homo sapiens
MPTQHLRTGLTRPHYTTPRARSCTGRVGSRVTPPGARPTSRAGWAATSGAAGHDPAHPPPARPIDSRVSCNPGTPTGDPGRRSAPIQAQRGATPVGPPVPRQLFRHSRAPRSRVRSDSSSSRGDRLQSGVRRCDTRPGAHPEGPQAAAPRVRAPVRPAEGVCRAGAGPASRGVAEVGGSSARPGPHARASPGLPPPLTGAGARLPDLQQQDDDGRQVGQVPSQPENVHGGGGGGGRRSAAAPGLGGSGGGGP

SEQ ID NO: 800299 - protein, 103 aa, Homo sapiens
FSKDGVFTMLARMVADVHRTLVYGGIFLYPANQKSPKGKLRLLYECNPVAYIIEQAGGLATTGTQPVLDVKPEAIHQRVPLILGSPEDVQEYLTCVQKNQAGS

SEQ ID NO: 800300 - protein, 339 aa, Homo sapiens
MTDRSPFETDMLTLTRYVMEKGRQAKGTGELTQLLNSMLTAIKAISSAVRKAGLAHLYGIAGSVNVTGDEVKKLDVLSNSLVINMLQSSYSTCVLVSEENKDAIITAKEKRGKYVVCFDPLDGSSNIDCLASIGTIFAIYRKTSEDEPSEKDALQCGRNIVAAGYALYGSATLVALSTGQGVDLFMLDPALGEFVLVEKDVKIKKKGKIYSLNEGYAKYFDAATTEYVQKKKFPEDGSAPYGARYVGSMVADVHRTLVYGGIFLYPANQKSPKGKLRLLYECNPVAYIIEQAGGLATTGTQPVLDVKPEAIHQRVPLILGSPEDVQEYLTCVQKNQAGS

SEQ ID NO: 800301 - protein, 163 aa, Homo sapiens
MPAPRHLTQRAPGQRFLGKSRRLQAVVPGIPPWCRRERGEPGRGGCGRWRRPGTGPVPGRGDPPSRAFRRSGQVGGGEGGGRGSRSKTELRLRVLRQQLLEDTVETQGGFIWVCKHPGPRLRFGRATPLLPRLARPHSARLVTARATCPRTLLRDGQKTWDSR

SEQ ID NO: 800302 - protein, 247 aa, Homo sapiens
MEFPKMLTRKIKLWDINAHITCRLCSGYLIDATTVTECLHTFCRSCLVKYLEENNTCPTCRIVIHQSHPLQYIGHDRTMQDIVYKLVPGLQEAEMRKQREFYHKLGMEVPGDIKGETCSAKQHLDSHRNGETKADDSSNKEAAEEKPEEDNDYHRSDEQVSICLECNSSKLRGLKRKWIRCSAQATVLHLKKFIAKKLNLSSFNELDILCNEEILGKDHTLKFVVVTRWRFKKAPLLLHYRPKMDLL

SEQ ID NO: 800303 - protein, 247 aa, Homo sapiens; identical to SEQ ID NO: 800302

SEQ ID NO: 800304 - protein, 247 aa, Homo sapiens; identical to SEQ ID NO: 800302

SEQ ID NO: 800305 - protein, 169 aa, Homo sapiens [sequence omitted]

SEQ ID NO: 800306 - protein, 180 aa, Homo sapiens
AYSTVFCHDRTMQDIVYKLVPGLQEAEMRKQREFYHKLGMEVPGDIKGETCSAKQHLDSHRNGETKADDSSNKEAAEEKPEEDNDYHRSDEQVSICLECNSSKLRGLKRKWIRCSAQATVLHLKKFIAKKLNLSSFNELDILCNEEILGKDHTLKFVVVTRWRFKKAPLLLHYRPKMDLL

SEQ ID NO: 800307 - protein, 247 aa, Homo sapiens; identical to SEQ ID NO: 800302

SEQ ID NO: 800308 - protein, 70 aa, Homo sapiens
TGVGELWGPHIFSLWRVTSPSRPFSSPPTGLQPCRESDAPGNTVLSHLLTRAPSACFPGLENLNSLQFSL

SEQ ID NO: 800309 - protein, 247 aa, Homo sapiens; identical to SEQ ID NO: 800302

SEQ ID NO: 800310 - protein, 247 aa, Homo sapiens; identical to SEQ ID NO: 800302

SEQ ID NO: 800311 - protein, 110 aa, Homo sapiens
MEFPKMLTRKIKLWDINAHITCRLCSGYLIDATTVTECLHTFCRSCLVKYLEENNTCPTCRIVIHQSHPLQYIGHDRTMQDIVYKLVPGLQEASACFPGLENLNSLQFSL

SEQ ID NO: 800312 - protein, 247 aa, Homo sapiens; identical to SEQ ID NO: 800302

SEQ ID NO: 800313 - protein, 242 aa, Homo sapiens
MLTRKIKLWDINAHITCRLCSGYLIDATTVTECLHTFCRSCLVKYLEENNTCPTCRIVIHQSHPLQYIGHDRTMQDIVYKLVPGLQEAEMRKQREFYHKLGMEVPGDIKGETCSAKQHLDSHRNGETKADDSSNKEAAEEKPEEDNDYHRSDEQVSICLECNSSKLRGLKRKWIRCSAQATVLHLKKFIAKKLNLSSFNELDILCNEEILGKDHTLKFVVVTRWRFKKAPLLLHYRPKMDLL

SEQ ID NO: 800314 - protein, 128 aa, Homo sapiens
MVRYVLFVLKGETKADDSSNKEAAEEKPEEDNDYHRSDEQVSICLECNSSKLRGLKRKWIRCSAQATVLHLKKFIAKKLNLSSFNELDILCNEEILGKDHTLKFVVVTRWRFKKAPLLLHYRPKMDLL

SEQ ID NO: 800315 - protein, 193 aa, Homo sapiens
SEDGADRTRDHPSTSLQYIGHDRTMQDIVYKLVPGLQEAEMRKQREFYHKLGMEVPGDIKGETCSAKQHLDSHRNGETKADDSSNKEAAEEKPEEDNDYHRSDEQVSICLECNSSKLRGLKRKWIRCSAQATVLHLKKFIAKKLNLSSFNELDILCNEEILGKDHTLKFVVVTRWRFKKAPLLLHYRPKMDLL

SEQ ID NO: 800316 - protein, 247 aa, Homo sapiens; identical to SEQ ID NO: 800302

SEQ ID NO: 800317 - protein, 247 aa, Homo sapiens; identical to SEQ ID NO: 800302

SEQ ID NO: 800318 - protein, 247 aa, Homo sapiens; identical to SEQ ID NO: 800302

SEQ ID NO: 800319 - protein, 247 aa, Homo sapiens; identical to SEQ ID NO: 800302

SEQ ID NO: 800320 - protein, 187 aa, Homo sapiens
MERSAFMELDAGSRLVMHLREWPALLVSSTGWTEFEQLTLDGHNLPSLVCVITGSVDLGVCLHMSSSGLDLPMKVVDMFGCCLPVCAVNFKCLHELVKHEENGLVFEDSEELAALQMLFSNFPDPAGKLNQFWKNLRESQQLRWDESWVQTVLPLVMDIQLLGQRLKPRDPCCPSRSFFSESQGKPF

SEQ ID NO: 800321 - protein, 207 aa, Homo sapiens
MKLGGTHSLFRACSEPEDAAMERSAFMELDAGSRLVMHLREWPALLVSSTGWTEFEQLTLDGHNLPSLVCVITGSVDLGVCLHMSSSGLDLPMKVVDMFGCCLPVCAVNFKCLHELVKHEENGLVFEDSEELAALQMLFSNFPDPAGKLNQFWKNLRESQQLRWDESWVQTVLPLVMDIQLLGQRLKPRDPCCPSRSFFSESQGKPF

SEQ ID NO: 800322 - protein, 111 aa, Homo sapiens
MDRWTDPQASTCGAEEAVRKGGGGKGLVQGVWLHRRHSSSHWHPAYKGKASKCAHQSLRVLLSGAHIQEQVCLSRVQARLCSVATGEEGPLLNTSLLLSLDQNKDLLARST

SEQ ID NO: 800323 - protein, 101 aa, Homo sapiens
SCLPGGWKEDILLCKGLSSKGSNFVQLLEILHLDHRTVELCHHLRDLCQSGCEGKTYTVCSGKGRQGSSPSSCQLNAAGKSLQSLHSIQRCLLSKNSAISL

SEQ ID NO: 800324 - protein, 86 aa, Homo sapiens
LFPRGSLKKREEQSDNPEEQDWPKTLSLIGGDILEEEPSSGLKFTGLPAVPLTGGRVWATETQPAEEREIWGKANASVMTLLFTNN

SEQ ID NO: 800325 - protein, 434 aa, Homo sapiens
MLRCLYHWHRPVLNRRWSRLCLLKQYLFTMKLQSPEFQSLFTEGLKSLTELFVKENHELRIAGGAVRDLLNGVKPQDIDFATTATPTQMKEMFQSAGIRMINNRGEKHGTITARLHEENFEITTLRIDVTTDGRHAEVEFTTDWQKDAERRDLTINSMFLGFDGTLFDYFNGYEDLKNKKVRFVGHAKQRIQEDYLRILRYFRFYGRIVDKPGDHDPETLEAIAENAKGLAGISGERIWVELKKILVGNHVNHLIHLIYDLDVAPYIGLPANASLEEFDKVSKNVDGFSPKPVTLLASLFKVQDDVTKLDLRLKIAKEEKNLGLFIVKNRKDLIKATDSSDPLKPYQDFIIDSREPDATTRVCELLKYQGEHCLLKEMQQWSIPPFPVSGHDIRKVGISSGKEIGALLQQLREQWKKSGYQMEKDELLSYIKKT

SEQ ID NO: 800326 - protein, 434 aa, Homo sapiens; identical to SEQ ID NO: 800325

SEQ ID NO: 800327 - protein, 356 aa, Homo sapiens
MLRCLYHWHRPVLNRRWSRLCLLKQYLFTMKLQSPEFQSLFTEGLKSLTELFVKENHELRIAGGAVRDLLNGVKPQDIDFATTATPTQMKEMFQSAGIRMINNRGEKHGTITARLHEENFEITTLRIDVTTDGRHAEVEFTTDWQKDAERRDLTINSMFLGFDGTLFDYFNGYEDLKNKKVRFVGHAKQRIQEDYLRILRYFRFYGRIVDKPGDHDPETLEAIAENAKGLAGISGERIWVELKKILVGNHVNHLIHLIYDLDVAPYIGLPANASLEEFDKVSKNVDGFSPKPVTLLASLFKVQDDVTKLDLRLKIAKEEKNLGLFIVKNRKDLIKATDSSDPLKPYQDFIIDVSIC

SEQ ID NO: 800328 - protein, 434 aa, Homo sapiens; identical to SEQ ID NO: 800325

SEQ ID NO: 800329 - protein, 434 aa, Homo sapiens; identical to SEQ ID NO: 800325

SEQ ID NO: 800330 - protein, 346 aa, Homo sapiens
MKEMFQSAGIRMINNRGEKHGTITARLHEENFEITTLRIDVTTDGRHAEVEFTTDWQKDAERRDLTINSMFLGFDGTLFDYFNGYEDLKNKKVRFVGHAKQRIQEDYLRILRYFRFYGRIVDKPGDHDPETLEAIAENAKGLAGISGERIWVELKKILVGNHVNHLIHLIYDLDVAPYIGLPANASLEEFDKVSKNVDGFSPKPVTLLASLFKVQDDVTKLDLRLKIAKEEKNLGLFIVKNRKDLIKATDSSDPLKPYQDFIIDSREPDATTRVCELLKYQGEHCLLKEMQQWSIPPFPVSGHDIRKVGISSGKEIGALLQQLREQWKKSGYQMEKDELLSYIKKT

SEQ ID NO: 800331 - protein, 165 aa, Homo sapiens
MLRCLYHWHRPVLNRRWSRLCLLKQYLFTMKLQSPEFQSLFTEGLKSLTELFVKENHELRIAGGAVRDLLNGVKPQDIDFATTATPTQMKEMFQSAGIRMINNRGEKHGTITARLHEENFEITTLRIDVTTDGRHAEVEFTTDWQKDAERRDLTINSMFLGNICR

SEQ ID NO: 800332 - protein, 163 aa, Homo sapiens
RTRGSTHASASLKCSTVVCVICLEKPKYRCPACRVPYCSVVCFRKHKEQCNPETRPVEKKIRSALPTKTVKPVENKDDDDSIADFLNSDEEEDRVSLQNLKNLGESATLRSLLLNPHLRQLMVNLDQGEDKAKLMRAYMQEPLFVEFADCCLGIVEPSQNEES

SEQ ID NO: 800333 - protein, 155 aa, Homo sapiens
MASLKCSTVVCVICLEKPKYRCPACRVPYCSVVCFRKHKEQCNPETRPVEKKIRSALPTKTVKPVENKDDDDSIADFLNSDEEEDRVSLQNLKNLGESATLRSLLLNPHLRQLMVNLDQGEDKAKLMRAYMQEPLFVEFADCCLGIVEPSQNEES

SEQ ID NO: 800334 - protein, 139 aa, Homo sapiens
MASLKCSTVVCVICLEKPKYRCPACRVPYCSVVCFRKHKEQCNPETRPVEKKIRSALPTKTVKPVENKGGRRQSFFAEFKEFRGICNIKKLIAQSTPQAVDGQPRSGRRQSKAHESLHARAFVCGVCRLLFRNCGAIPE

SEQ ID NO: 800335 - protein, 148 aa, Homo sapiens
MASLKCSTVVCVICLEKPKYRCPACRVPYCSVVCFRKHKEQCNPETRPVEKKIRSALPTKTVKPVENKDDDDSIADFLNSDEEEDRVSLQNLKNLDGLSSCHPGWSAAAQSRLTATSPSQIQAILMPQPPEQLGLQAPATTPNQFLYF

SEQ ID NO: 800336 - protein, 155 aa, Homo sapiens; identical to SEQ ID NO: 800333

SEQ ID NO: 800337 - protein, 107 aa, Homo sapiens
RTRGSTHASASLKCSTVVCVICLEKPKYRCPACRVPYCSVVCFRKHKGESATLRSLLLNPHLRQLMVNLDQGEDKAKLMRAYMQEPLFVEFADCCLGIVEPSQNEES

SEQ ID NO: 800338 - protein, 109 aa, Homo sapiens
MPGSGVCLIHKSFFVQLSSAKFNLSEVFLLTDGVRNGPQSRAPSDPPGALSDHKGYLLGPSSRSVHCSLTATGDCGCILSQILKLHTLPFSAVQACLSKFLILAEFGSR

SEQ ID NO: 800339 - protein, 109 aa, Homo sapiens; identical to SEQ ID NO: 800338
